(12) United States Patent
Chen et al.

(10) Patent No.: US 11,273,442 B1
(45) Date of Patent: *Mar. 15, 2022

(54) PROGRAMMABLE NUCLEASE COMPOSITIONS AND METHODS OF USE THEREOF

(71) Applicant: MAMMOTH BIOSCIENCES, INC., Brisbane, CA (US)

(72) Inventors: Janice Sha Chen, San Francisco, CA (US); Ashley Tehranchi, San Francisco, CA (US); Andrew Besancon Lane, San Francisco, CA (US); James Paul Broughton, San Francisco, CA (US); Lucas Benjamin Harrington, Berkeley, CA (US); Maria-Nefeli Tsaloglou, San Francisco, CA (US); Xin Miao, Mountain View, CA (US); Clare Louise Fasching, Redwood City, CA (US); Jasmeet Singh, Santa Clara, CA (US); Pedro Patrick Draper Galarza, Oakland, CA (US)

(73) Assignee: MAMMOTH BIOSCIENCES, INC., Brisbane, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 17/037,592

(22) Filed: Sep. 29, 2020

Related U.S. Application Data

(63) Continuation of application No. PCT/US2019/044763, filed on Aug. 1, 2019.

(60) Provisional application No. 62/713,379, filed on Aug. 1, 2018, provisional application No. 62/722,024, filed on Aug. 23, 2018, provisional application No. 62/787,123, filed on Dec. 31, 2018, provisional application No. 62/788,702, filed on Jan. 4, 2019, provisional application No. 62/788,701, filed on Jan. 4, 2019, provisional application No. 62/863,184, filed on Jun. 18, 2019, provisional application No. 62/879,332, filed on Jul. 26, 2019.

(51) Int. Cl.
| | |
|---|---|
| *C12Q 1/68* | (2018.01) |
| *B01L 3/00* | (2006.01) |
| *C12N 9/22* | (2006.01) |
| *C12N 15/113* | (2010.01) |
| *C12Q 1/6816* | (2018.01) |

(52) U.S. Cl.
CPC .......... *B01L 3/502715* (2013.01); *C12N 9/22* (2013.01); *C12N 15/113* (2013.01); *C12Q 1/6816* (2013.01); *C12N 2310/20* (2017.05)

(58) Field of Classification Search
CPC ... C12Q 1/6816; B01L 3/502715; C12N 9/22; C12N 15/113; C12N 2310/20
See application file for complete search history.

(56) References Cited

U.S. PATENT DOCUMENTS

| | | |
|---|---|---|
| 3,687,808 A | 8/1972 | Merigan, Jr. et al. |
| 5,034,506 A | 7/1991 | Summerton et al. |
| 5,489,677 A | 2/1996 | Sanghvi et al. |
| 5,539,082 A | 7/1996 | Nielsen et al. |
| 5,602,240 A | 2/1997 | De Mesmaeker et al. |
| 5,714,331 A | 2/1998 | Buchardt et al. |
| 5,719,262 A | 2/1998 | Buchardt et al. |
| 6,312,928 B1 | 11/2001 | Van Gemen et al. |
| 6,773,885 B1 | 8/2004 | Walder et al. |
| 8,030,000 B2 | 10/2011 | Piepenburg et al. |
| 8,426,134 B2 | 4/2013 | Piepenburg et al. |
| 8,586,718 B2 | 11/2013 | Benson et al. |
| 8,597,886 B2 | 12/2013 | Smith et al. |
| 8,815,782 B2 | 8/2014 | Zeiner et al. |
| 8,822,673 B2 | 9/2014 | Chou et al. |
| 8,945,845 B2 | 2/2015 | Piepenburg et al. |
| 9,309,502 B2 | 4/2016 | Piepenburg et al. |
| 9,415,392 B2 * | 8/2016 | Ismagilov .............. C12Q 1/703 |
| 9,663,820 B2 | 5/2017 | Piepenburg et al. |
| 9,730,967 B2 | 8/2017 | Kovarik et al. |
| 9,790,490 B2 | 10/2017 | Zhang et al. |
| 10,113,179 B2 | 10/2018 | Begemann et al. |

(Continued)

FOREIGN PATENT DOCUMENTS

| | | |
|---|---|---|
| CN | 106701830 A | 5/2017 |
| CN | 107488710 A | 12/2017 |

(Continued)

OTHER PUBLICATIONS

Chen, et al. CRISPR-Cas12a target binding unleashes indiscriminate single-stranded DNase activity. Science. Apr. 27, 2018;360(6387):436-439. (Supplemental Material).

(Continued)

*Primary Examiner* — David C Thomas

(74) *Attorney, Agent, or Firm* — Wilson Sonsini Goodrich & Rosati

(57) ABSTRACT

Described herein are devices, systems, fluidic devices, kits, and methods for detection of target nucleic acids associated with diseases, cancers, genetic disorders, a genotype, a phenotype, or ancestral origin. The devices, systems, fluidic devices, kits, and methods may comprise reagents of a guide nucleic acid targeting a target nucleic acid, a programmable nuclease, and a single stranded detector nucleic acid with a detection moiety. The target nucleic acid of interest may be indicative of a disease, and the disease may be communicable diseases, or of a cancer or genetic disorder. The target nucleic acid of interest may be indicative of a genotype, a phenotype, or ancestral origin.

51 Claims, 106 Drawing Sheets

Specification includes a Sequence Listing.

(56) References Cited

U.S. PATENT DOCUMENTS

| | | | |
|---|---|---|---|
| 10,253,365 B1 | 4/2019 | Doudna et al. |
| 10,266,886 B2 | 4/2019 | Abudayyeh et al. |
| 10,266,887 B2 | 4/2019 | Abudayyeh et al. |
| 10,316,324 B2 | 6/2019 | Begemann et al. |
| 10,337,051 B2 | 7/2019 | Doudna et al. |
| 10,494,664 B2 | 12/2019 | Doudna et al. |
| 10,570,415 B2 | 2/2020 | Doudna et al. |
| 10,648,020 B2 | 5/2020 | Zhang et al. |
| 2003/0003486 A1 | 1/2003 | Sauer et al. |
| 2006/0179585 A1 | 8/2006 | Zilles et al. |
| 2011/0172420 A1 | 7/2011 | Zilles et al. |
| 2011/0190486 A1 | 8/2011 | Zilles et al. |
| 2011/0223677 A1 | 9/2011 | Arden-Jacob et al. |
| 2011/0293703 A1 | 12/2011 | Mahon et al. |
| 2013/0224871 A1 | 8/2013 | Zilles et al. |
| 2013/0261196 A1 | 10/2013 | Diamond et al. |
| 2013/0323851 A1 | 12/2013 | Arden-Jacob et al. |
| 2014/0068797 A1 | 3/2014 | Doudna et al. |
| 2014/0093883 A1 | 4/2014 | Maples et al. |
| 2014/0194611 A1 | 7/2014 | Cook et al. |
| 2014/0273226 A1 | 9/2014 | Wu |
| 2014/0349295 A1 | 11/2014 | Hosaka et al. |
| 2014/0378330 A1 | 12/2014 | Petrauskene et al. |
| 2015/0211058 A1 | 7/2015 | Carstens |
| 2015/0325006 A1 | 11/2015 | Adiri et al. |
| 2016/0138008 A1 | 5/2016 | Doudna et al. |
| 2016/0208243 A1 | 7/2016 | Zhang et al. |
| 2017/0037432 A1 | 2/2017 | Donohoue et al. |
| 2017/0051276 A1 | 2/2017 | May et al. |
| 2017/0175104 A1 | 6/2017 | Doudna et al. |
| 2017/0198277 A1 | 7/2017 | Kmiec et al. |
| 2017/0211142 A1 | 7/2017 | Smargon et al. |
| 2017/0233756 A1 | 8/2017 | Begemann et al. |
| 2017/0306335 A1 | 10/2017 | Zhang et al. |
| 2017/0321198 A1 | 11/2017 | Severinov et al. |
| 2017/0321214 A1 | 11/2017 | Zhang et al. |
| 2017/0349913 A1 | 12/2017 | Chen |
| 2018/0155716 A1 | 6/2018 | Zhang et al. |
| 2018/0179503 A1 | 6/2018 | Maianti et al. |
| 2018/0208976 A1 | 7/2018 | Doudna et al. |
| 2018/0208977 A1 | 7/2018 | Doudna et al. |
| 2018/0274017 A1 | 9/2018 | Abudayyeh et al. |
| 2018/0282713 A1 | 10/2018 | Van Der Oost |
| 2018/0298445 A1 | 10/2018 | Abudayyeh et al. |
| 2018/0305704 A1 | 10/2018 | Zhang |
| 2018/0320163 A1 | 11/2018 | Koonin et al. |
| 2018/0327786 A1 | 11/2018 | Severinov et al. |
| 2018/0340218 A1 | 11/2018 | Abudayyeh et al. |
| 2018/0362943 A1 | 12/2018 | Chittoor et al. |
| 2019/0010481 A1 | 1/2019 | Joung et al. |
| 2019/0070610 A1* | 3/2019 | Haworth ............... B01L 3/0293 |
| 2019/0071717 A1 | 3/2019 | Zhang et al. |
| 2019/0083656 A1 | 3/2019 | Khalili et al. |
| 2019/0093107 A1 | 3/2019 | Zhang et al. |
| 2019/0144929 A1 | 5/2019 | Abudayyeh et al. |
| 2019/0177775 A1 | 6/2019 | Doudna et al. |
| 2019/0202856 A1 | 7/2019 | Davis et al. |
| 2019/0218602 A1 | 7/2019 | Zhang et al. |
| 2019/0241954 A1 | 8/2019 | Doudna et al. |
| 2019/0256900 A1 | 8/2019 | Zhang et al. |
| 2019/0264186 A1 | 8/2019 | Yamano et al. |
| 2019/0276842 A1 | 9/2019 | Doudna et al. |
| 2019/0300908 A1 | 10/2019 | Doudna et al. |
| 2019/0309357 A1 | 10/2019 | Abudayyeh et al. |
| 2020/0010817 A1 | 1/2020 | Van Der Oost |
| 2020/0010878 A1 | 1/2020 | Doudna et al. |
| 2020/0010879 A1 | 1/2020 | Doudna et al. |
| 2020/0017879 A1 | 1/2020 | Doudna et al. |
| 2020/0032242 A1* | 1/2020 | Schneider ............ C12N 15/1006 |
| 2020/0087640 A1 | 3/2020 | Doudna et al. |
| 2020/0181720 A1 | 6/2020 | Abudayyeh et al. |
| 2020/0238274 A1* | 7/2020 | Breidenbach ............ B01L 3/502 |
| 2020/0254443 A1 | 8/2020 | Zhang et al. |
| 2020/0277600 A1 | 9/2020 | Zhang et al. |
| 2020/0299768 A1 | 9/2020 | Doudna et al. |
| 2020/0392473 A1 | 12/2020 | Zhang et al. |

FOREIGN PATENT DOCUMENTS

| | | |
|---|---|---|
| EP | 2825654 A1 | 1/2015 |
| EP | 3009511 A2 | 4/2016 |
| EP | 3251332 A1 | 12/2017 |
| EP | 3252160 A1 | 12/2017 |
| EP | 3283625 A1 | 2/2018 |
| EP | 3310917 A1 | 4/2018 |
| EP | 3430134 A1 | 1/2019 |
| EP | 3436575 A1 | 2/2019 |
| EP | 3445848 A1 | 2/2019 |
| EP | 3455357 A1 | 3/2019 |
| EP | 3470519 A1 | 4/2019 |
| EP | 3500967 A1 | 6/2019 |
| EP | 3502253 A1 | 6/2019 |
| EP | 3546573 A1 | 10/2019 |
| EP | 3551753 A1 | 10/2019 |
| EP | 3596218 A1 | 1/2020 |
| EP | 3604532 A1 | 2/2020 |
| EP | 3653722 A1 | 5/2020 |
| JP | 6495395 B2 | 4/2019 |
| KR | 101897213 B1 | 9/2018 |
| WO | WO-9839352 A1 | 9/1998 |
| WO | WO-9914226 A2 | 3/1999 |
| WO | WO-0142505 A2 | 6/2001 |
| WO | WO-0186001 A1 | 11/2001 |
| WO | WO-2014118272 A1 | 8/2014 |
| WO | WO-2015071474 A2 | 5/2015 |
| WO | WO-2015191693 A2 | 12/2015 |
| WO | WO-2016028843 A2 | 2/2016 |
| WO | WO-2016094867 A1 | 6/2016 |
| WO | WO-2016094872 A1 | 6/2016 |
| WO | WO-2016106236 A1 | 6/2016 |
| WO | WO-2016123243 A1 | 8/2016 |
| WO | WO-2016205613 A1 | 12/2016 |
| WO | WO-2016205711 A1 | 12/2016 |
| WO | WO-2016205749 A1 | 12/2016 |
| WO | WO-2016205764 A1 | 12/2016 |
| WO | WO-2017070605 A1 | 4/2017 |
| WO | WO-2017120410 A1 | 7/2017 |
| WO | WO-2017147345 A1 | 8/2017 |
| WO | WO-2017176529 A1 | 10/2017 |
| WO | WO-2017184768 A1 | 10/2017 |
| WO | WO-2017184786 A1 | 10/2017 |
| WO | WO-2017189308 A1 | 11/2017 |
| WO | WO-2017205668 A1 | 11/2017 |
| WO | WO-2017209809 A1 | 12/2017 |
| WO | WO-2017218185 A1 | 12/2017 |
| WO | WO-2017218573 A1 | 12/2017 |
| WO | WO-2017219027 A1 | 12/2017 |
| WO | WO-2017223538 A1 | 12/2017 |
| WO | WO-2018064352 A1 | 4/2018 |
| WO | WO-2018064371 A1 | 4/2018 |
| WO | WO-2018107129 A1 | 6/2018 |
| WO | WO-2018170333 A1 | 9/2018 |
| WO | WO-2018170340 A1 | 9/2018 |
| WO | WO-2018195545 A2 | 10/2018 |
| WO | WO-2019005853 A2 | 1/2019 |
| WO | WO-2019005856 A1 | 1/2019 |
| WO | WO-2019011022 A1 | 1/2019 |
| WO | WO-2019051318 A1 | 3/2019 |
| WO | WO-2019071051 A1 | 4/2019 |
| WO | WO-2019079787 A1 | 4/2019 |
| WO | WO-2019089796 A1 | 5/2019 |
| WO | WO-2019089804 A1 | 5/2019 |
| WO | WO-2019089808 A1 | 5/2019 |
| WO | WO-2019089820 A1 | 5/2019 |
| WO | WO-2019104058 A1 | 5/2019 |
| WO | WO-2019126577 A2 | 6/2019 |
| WO | WO-2019126774 A1 | 6/2019 |
| WO | WO-2019148206 A1 | 8/2019 |
| WO | WO-2020028729 A1 | 2/2020 |
| WO | WO-2020142754 A2 | 7/2020 |
| WO | WO-2020142754 A3 | 9/2020 |
| WO | WO-2020257356 A2 | 12/2020 |

(56) References Cited

FOREIGN PATENT DOCUMENTS

OTHER PUBLICATIONS

Forster et al., "A human gut bacterial genome and culture collection for improved metagenomics analyses", Nature Biotechnology, vol. 37, Feb. 2019, pp. 186-192. (Year: 2019).
GenBank OHA03494.1 (hypothetical protein A3J58_03210 [Candiatus Sung bacterial bacterium FIFCSPH IGH02_02 FULL_52_23], NCBI Reference Sequence, priority to Oct. 21, 2016, 2 pages) (Year:2016).
PCT/US2019/044763 International Preliminary Report on Patentability dated Feb. 2, 2021.
PCT/US2020/038242 International Search Report and Written Opinion dated Jan. 28, 2021.
Sah et al., Complete genome sequence of a 2019 novel coronavirus (SARS-CoV-2) strain isolated in Nepal. Microbiol Resour Announc. 9(11):e00169-20 (2020).
U.S. Appl. No. 17/037,594 Non-Final Office Action dated Feb. 3, 2021.
U.S. Appl. No. 17/037,620 Non-Final Office Action dated Mar. 24, 2021.
Zeberg et al., The major genetic risk factor for severe COVID-19 is inherited from Neanderthals. Nature 587(7835):610-612 (2020).
Abraham et al.: Fluorescent Protein Based FRET Pairs with Improved Dynamic Range for Fluorescence Lifetime Measurements. PLoS One. 10(8): e0134436, 15 pages total (2015).
Abudayyeh, et al. C2c2 is a single-component programmable RNA-guided RNA-targeting CRISPR effector. Science. 353.6299 (Aug. 5, 2016).
Abudayyeh, et al.; "C2c2 is a single-component programmable RNA-guided RNA-targeting CRISPR effector; Supplementary Information"; Science; vol. 353, vol. 6299, 31 pages (Aug. 5, 2016).
Abudayyeh, et al. RNA targeting with CRISPR-Cas13. Nature, 550, (Oct. 12, 2017): 18 pages.
Ackerman et al.: 5—Comprehensive and Multiplexed Nucleic Acid Detection with Cas13. Session S330—CRISPR Tools. Itinerary. Abstract (2020).
Ackerman et al.: Massively multiplexed nucleic acid detection with Cas13. Nature. 582(7811): 277-282 (2020).
Alhasan et al.: Exosome encased spherical nucleic acid gold nanoparticle conjugates as potent microRNA regulation agents. Small. 10(1): 186-192 (2014).
Altschul, et al. Basic local alignment search tool. J Mol Biol. Oct. 5, 1990;215(3):403-10.
Ambion; "RnaseAlert Lab Test Kit v2, User Guide"; 12 pages (Mar. 1, 2013).
Anantharaman et al. (2016) Thousands ofmicrobial genomes shed light on interconnected biogeochemical processes in anaquifer system. Nature Communications, 7:13219, pp. 1-11 (Year: 2016).
Applied Biosystems/Ambion; "RNaseAlert Lab Test Kit"; 12 pages (2008).
Armitage, et al. Hairpin-Fornning Peptide Nucleic Acid Oligomers. Biochemistry, 37 (1998): 9417-9425.
Bajar er al.: A Guide to Fluorescent Protein FRET Pairs. Sensors (Basel). 16(9): 1488, 24 pages total (2016).
Baker, et al.; "Enigmatic, ultrasmall,uncultivated Archaea"; PNAS; vol. 107, No. 19, pp. 8806-8811 (May 11, 2010).
Baksh et al.: Detection of molecular interactions at membrane surfaces through colloid phase transitions. Nature.427(6970): 139-141 (2004).
Ball et al.: Quenching of Unincorporated Amplification Signal Reporters in Reverse-Transcription Loop-Mediated Isothermal Amplification Enabling Bright, Single-Step, Closed-Tube, and Multiplexed Detection of RNA Viruses. Anal Chem. 88(7): 3562-3568 (2016).
Bao et al.: Fluorescent probes for live-cell RNA detection. Annu Rev Biomed Eng. 11: 25-47 (2009).
Barrangou, et al. Expanding the CRISPR Toolbox: Targeting RNA with Cas13b. Molecular Cell. 65.4 (Feb. 16, 2017): 582-584.
Bautista, et al.; "Virus-Induced Dormancyin the Archaeon Sulfolobusislandicus"; mBio; vol. 6, No. 2, 8 pages (2015).
Braasch et al., Novel Antisense and Peptide Nucleic Acid Strategies for Controlling Gene Expression, Biochemistry, 41(14):4503-4509, 2002.
Burnstein et al.: New CRISPR-Cas systems from uncultivated microbes. Nature 542(7640): 237-241 (2017).
Bustin. Quanlification of mRNA using real-time reverse transcription PCR (RT-PCR): trends and problems. J Mol Endocrinol 29(1):23-39 (2002).
Chen, et al. CRISPR-Cas12a target binding unleashes indiscriminate single-stranded DNase activity. Science. Apr. 27, 2018;360(6387):436-439. doi: 10.1126/science.aar6245. Epub Feb. 15, 2018.
Chen, et al. CRISPR-Cas12a target binding unleashes single-stranded DNase activity. Nov. 29, 2017. bioRxiv 226993; doi: https://doi.org/10.1101/226993.
Chen et al.: Enhanced proofreading governs CRISPR-Cas9 targeting accuracy. NATURE 550(7676): 407-410 (2017).
Chen et al.: Molecular basis for the PAM expansion and fidelity enhancement of an evolved Cas9 nuclease. PLOS BIOLOGY 17(10): e3000496 (2019).
Choi et al.: Mechanism for the endocytosis of spherical nucleic acid nanoparticle conjugates. Proc Natl Acad Sci U S A.110(19): 7625-7630 (2013).
Choudhury et al.: CRISPR-dCas9 mediated TET1 targeting for selective DNA demethylation at BRCA1 promoter. ONCOTARGET 7(29): 46545-46556 (2016).
Chylinski et al. Classification and evolution of type II CRISPR-Cas Systems. Nucleic Acids Res 42(10):6091-6105 (2014).
Cong et al. Multiplex genome engineering using CRISPR/Cas systems. Science 339(6121):819-23 (2013).
Co-pending U.S. Appl. No. 16/927,351, inventors Doudna; Jennifer A. et al., filed Jul. 13, 2020.
Co-pending U.S. Appl. No. 17/037,594, inventors Chen; Janice Sha et al., filed Sep. 29, 2020.
Co-pending U.S. Appl. No. 17/037,620, inventors Harrington; Lucas Benjamin et al., filed Sep. 29, 2020.
Co-pending U.S. Appl. No. 17/039,865, inventors Chen; Janice Sha et al., filed Sep. 30, 2020.
Co-pending U.S. Appl. No. 17/039,928, inventors Chen; Janice Sha et al., filed Sep. 30, 2020.
Cox, et al. RNA editing with CRISPR-Cas13. Science, 358.6366 (Nov. 24, 2017): 15 pages.
CRAW et al.: Isothermal nucleic acid amplification technologies for point-of-care diagnostics: a critical review. Lab Chip.12(14): 2469-2486 (2012).
Cutler et al.: Polyvalent nucleic acid nanostructures. J Am Chem Soc. 133(24): 9254-9257 (2011).
Cutler et al.: Spherical nucleic acids. J Am Chem Soc. 134(3): 1376-1391 (2012).
Deltcheva et al. Crispr RNA maturation by trans-encoded small RNA and host factor RNase III. Nature 471:602-607 (2011).
East-Seletsky, et al. RNA Targeting by Functionally Orthogonal Type VI-A CRISPR-Cas Enzymes. Molecular Cell. 66 (May 4, 2017): 373-383.
East-Seletsky, et al. Two distinct Rnase activities of CRISPR-C2c2 enable guide-RNA processing and RNA detection. Nature. 538. 7624 (Oct. 13, 2016): 270-273.
European Patent Application No. 17813959 European Search Opinion and Extended European Search Report dated Jun. 12, 2019.
Fonfara et al. Phylogeny of Cas9 determines functional exchangeability of dual-RNA and Cas9 among orthologous type II CRISPR-Cas systems. Nucleic Acids Res 42(4):2577-2590 (2013).
Gale et al.: A Review of Current Methods in Microfluidic Device Fabrication and Future Commercialization Prospects.Inventions 3(60): 1-25 (2018).
Gao et al.: Engineered Cpf1 variants with altered PAM specificities. Nature Biotechnology 35(8): 789-792 (2017).
GenBank CRZ35554 1; "Hypothetical protein HHT355_2368 [Herbinix hemicellulosilytica]"; 1 page (Oct. 11, 2018).

(56) References Cited

OTHER PUBLICATIONS

Gill, et al. Nucleic acid isothermal amplification technologies: a review. Nucleosides Nucleotides Nucleic Acids. Mar. 2008;27(3):224-43. doi: 10.1080/15257770701845204.
Gootenberg, et al. Multiplexed and portable nucleic acid detection platform with Cas13, Cas12a, and Csm6. Science. Apr. 27, 2018;360(6387):439-444. doi: 10.1126/science.aaq0179. Epub Feb. 15, 2018.
Gootenberg, et al. Nucleic acid detection with CRISPR-Cas13a/C2c2. Science, (Apr. 13, 2017): 9 pages.
Gu et al., Depletion of abundant sequences by hybridization (DASH): using Cas9 to remove unwanted high-abundance species in sequencing libraries and molecular counting applications. Genome Biology, 17:41, 13 pages, 2016.
Hale, et al. RNA-guided RNA cleavage by a CRISPR RNA-Cas protein complex. Cell. Nov. 25, 2009;139(5):945-56. doi: 10.1016/j.cell.2009.07.040.
Hale, et al. Target RNA capture and cleavage by the Cmr type III-B CRISPR-Cas effector complex. Genes & Development. 28.21 (Nov. 1, 2014): 2432-2443.
Hao et al.: Nucleic acid-gold nanoparticle conjugates as mimics of microRNA. Small.7(22): 3158-3162 (2011).
Harrington et al.: Programmed DNA destruction by miniature CRISPR-Cas14 enzymes. Science. 362(6416): 839-842 (2018).
Hendel, et al. Chemically modified guide RNAs enhance CRISPR-Cas genome editing in human primary cells. Nat Biotechnol. Sep. 2015;33(9):985-9. doi: 10.1038/nbt.3290. Epub Jun. 29, 2015.
Hooton et al.: The Bacteriophage Carrier State of Campylobacter jejuni Features Changes in Host Non-coding RNAs and the Acquisition of New Host-derived CRISPR Spacer Sequences. Frontiers in Microbiology 7(355): 1-8(2016).
Hui Yang and Dinshaw J. Patel: "New CRISPR-Cas systemsdiscovered", Cell Research—Xibao Yanjiu, vol. 27, No. 3, Feb. 21, 2017, pp. 313-314.
Jacobsen et al.: The *Acidaminococcus* sp. Cas12a nuclease recognizes GTTV and GCTV as non-canonical PAMs. FEMS Microbiology Letters 366(8): 7 pages (2019).
Jensen et al.: Spherical nucleic acid nanoparticle conjugates as an RNAi-based therapy for glioblastoma. Sci Transl Med. 5(209): 209ra152, 22 pages total (2013).
Karvelis et al.: (2020) PAM recognition by miniature CRISPR-Cas12f nucleases triggers programmable double-stranded DNA target cleavage. Nucleic Acids Research, gkaa208: pp. 1-8 (Year: 2020).
Karvelis et al.: PAM recognition by miniature CRISPR-Cas14 triggers programmable double-stranded DNA target cleavage. Nucleic Acids Research, doi: 10.1093/nar/gkaa208: 10 pages (2020).
Kelemen, et al. Hypersensitive substrate for ribonucleases. Nucleic Acids Research, 27.18 (1999): 3696-3701.
Kim, et al.; "Specific and sensitive detection of nucleic acids and RNases using gold nanoparticle-RNA-fluorescent dye conjugates"; Chemical Communications; vol. 14, No. 42, pp. 4342-4344 (Sep. 19, 2007).
Kleinstiver et al.: Engineered CRISPR-Cas12a variants with increased activities and improved targeting ranges forgene, epigenetic and base editing. Nature Biotechnology 37(3): 276-282 (2019).
Knott, et al. Guide-bound structures of an RNA-targeting A-cleaving CRISPR-Cas13a enzyme. Nature Structural & Molecular Biology, 24.10 (Oct. 2017): 13 pages.
Kodak (Gel Logic 100 System User's Guide, 2005, 98 pages) (Year: 2005).
Koonin et al. (2017) Diversity, classification and evolution of CRISPR-Cas systems. Current Opinion in Microbiology, 37:67-78 (Year: 2017).
Koshkin et al. LNA (locked nucleic acids): synthesis of the adenine, cytosine, guanine 5-methylcytosine, thymine and uracil bicyclonucleoside monomers, oligomerisation, and unprecedented nucleic acid recognition. Tetrahedron 54(14):3607-3630 (1998).
Lawi et al.: A Microfluidic Cartridge System for Multiplexed Clinical Analysis. JALA Charlottesv Va. 14(6): 407-412 (2009).
Lee et al.: Directed evolution of CRISPR-Cas9 to increase its specificity. Nature Communications 9(1): 3048. 10 pages (2018).
Li, et al. CRISPR-Cas12a has both cis- and trans-cleavage activities on single-stranded DNA. Cell Res. Apr. 2018;28(4):491-493. doi: 10.1038/S41422-018-0022-x. Epub Mar. 12, 2018.
Li, et al. Using molecular beacons as a sensitive fluorescence assay for enzymatic cleavage of single-stranded DNA. Nucleic Acids Res. Jun. 1, 2000;28(11):E52.
LIANG et al.: Genotyping genome-edited mutations in plants usingCRISPR ribonucleoprotein complexes. Plant Biotechnology Journal 16: 2053-2062 (2018).
Liu, et al.; "CasX enzymes comprise adistinct family of RNA-guided genome editors"; Nature; vol. 566, pp. 23pages (Feb. 14, 2019).
Liu et al.: Synthetic chimeric nucleases function for efficient genome editing. Nature Communications 10(1): 5524. 11 pages (2019).
Liu, et al. The Molecular Architecture for RNA-Guided RNA Cleavage by Cas13a. Cell, 170 (Aug. 10, 2017): 714-726.
Liu, et al. Two Distant Catalytic Sites Are Responsible for C2c2 RNase Activities. Cell, (Jan. 12, 2017): 168, 121-134.
Livak, et al. Oligonucleotides with fluorescent dyes at opposite ends provide a quenched probe system useful for detecting PCR product and nucleic acid hybridization. PCR Methods Appl. Jun. 1995;4(6):357-62.
Makarova et al.: Evolutionary classification of CRISPR-Cas systems: a burst of class 2 and derived variants. Nat Rev Microbiol. 18(2): 67-83 (2020) [Review Article published Dec. 19, 2019].
Martin. A New Access to 2'-O-Alkylated Ribonucleosides and Properties of 2'-O-Alkylated Oligoribonucleotides. Helv. Chim. Acta. 1995; 78:486-504. (in German with English abstract).
Mauk et al.: Microfluidic devices for nucleic acid (NA) isolation, isothermal NA amplification, and real-time detection. Methods Mol. Biol. 1256: 15-40 (2015).
Maxwell et al.: A detailed cell-free transcription-translation-based assay to decipher CRISPR protospacer-adjacent motifs. METHODS 143: 48-57 (2018).
Miao et al.: Systematically investigating the key features of the nuclease deactivated Cpf1 for tunable multiplex genetic regulation. bioRxiv. 23 pages (2018).
Mirkin, C.: Interview: An interview with Chad Mirkin: nanomedicine expert. Interviewed by Hannah Stanwix. Nanomedicine (Lond). 7(5): 635-638 (2012).
Murugan et al.: The Revolution Continues: Newly Discovered Systems Expand the CRISPR-Cas Toolkit. Molecular Cell 68(1): 15-25 (2017).
Nair et al.: Multivalent N-acetylgalactosamine-conjugated siRNA localizes in hepatocytes and elicits robust RNAi-mediated gene silencing. J Am Chem Soc. 136(49): 16958-16961 (2014).
Ngo et al. Computational complexity, protein structure prediction, and the levinthal paradox. In: The Protein Folding Problem and Tertiary Structure Prediction. K. Merz, Jr., et al. Eds. 1994:433-506.
O'Connell, M.R.: Molecular Mechanisms of RNA Targeting by Cas13-containing Type VI CRISPR-Cas Systems. J Mol Biol. 431(1): 66-87 (2019).
Panyam et al.: Biodegradable nanoparticles for drug and gene delivery to cells and tissue. Advanced Drug Delivery Reviews 55(3): 329-347 (2003).
PCT/US2019/044763 International Search Report and Written Opinion dated Jan. 15, 2020.
PCT/US2020/012276 International Search Report and Written Opinion dated Aug. 3, 2020.
Qin et al.: Rapid and fully microfluidic ebola virus detection with CRISPR-Cas13a. ACS. Sens.4(4): 1048-1054 (2019).
Qiu et al.: Microfuidic channel optimization to improve hydrodynamic dissociation of cell aggregates and tissue. Scientific Reports vol. 8, Article No. 2774, pp. 1-10 (2018).
Quan et al.: FLASH: a next-generation CRISPR diagnostic for multiplexed detection of antimicrobial resistance sequences. Nucleic Acids Res. 47(14): e83, 9 pages total (2019).
RNaseAlert Lab Test Kit (Applied Biosystems, Fluorometric RNase Detection Assay, 2008, 12 pages). (Year: 2008).
Rothberg, et al. An integrated semiconductor device enabling non-optical genome sequencing. Nature. 475 (2011): 348-352.

(56) References Cited

OTHER PUBLICATIONS

Sato, et al. Highly Sensitive Nuclease Assays Based on Chemically Modified DNA or RNA. Sensors, 14.7 (2014): 12437-12450.
Shah et al.: Single-molecule RNA detection at depth by hybridization chain reaction and tissue hydrogel embedding and clearing. Development. 143(15): 2862-2867 (2016).
Shmakov et al. Discovery and Functional Characterization of Diverse Class 2 CRISPR-Cas Systems. Mol Cell 60(3):385-397 (2015).
Shmakov, et al.: Diversity and evolution of class 2 CRISPR-Cas systems. Nature Reviews Microbiology 15(3): 169-182 (2017).
Singh et al. LNA (locked nucleic acids): synthesis and high-affinity nucleic acid recognition. Chem Commun 4:455-456 (1998).
Smargon, et al. Cas13b is a Type VI-B CRISPR-associated RNA-Guided RNAse differentially regulated by accessory proteins Csx27 and Csx28. Molecular Cell, 65.4, (Feb. 16, 2017): 618-630.
Smith et al. Comparison of Biosequences. Advances in Applied Mathematics. 2:482-489 (1981).
Smith et al.: Microfluidic Cartridges for Automated, Point-of-Care Blood Cell Counting. SLAS Technology 22(2): 176-185 (2017).
Spoelstra et al.: CRISPR-based DNA and RNA detection with liquid phase separation. bioRxiv preprint doi: https://doi.org/10.1101/471482 . 20 pages total (2018).
Stephen Floor; "CV"; 6 pages (Jun. 11, 2018).
Stephen Floor; "Tweets cited in third party observation filed on Oct. 15, 2018"; 1 page (date of tweets are May 21, 2016).
Sternberg et al. DNA interrogation by the CRISPR RNA-guided endonuclease Cas9. Nature 507(7490):62-67 (2014).
Straub et al.: Zinc fingers, TAL effectors, or Cas9-based DNA binding proteins: what's best for targeting desired genome loci? Mol Plant. 6(5): 1384-1387 (2013).
Swarts et al.: Mechanistic Insights into the cis- and trans-Acting DNase Activities of Cas12a. Mol Cell. 73: 589-600(2019).
Swarts et al.: Structural Basis for Guide RNA Processing and Seed-Dependent DNA Targeting by CRISPR-Cas12a. Molecular Cell 66(2): 221-233 (2017).
Tambe et al.: RNA Binding and HEPN-Nuclease Activation Are Decoupled in CRISPR-Cas13a. Cell Rep.24(4): 1025-1036 (2018).
Teng et al.: Enhanced mammalian genome editing by new Cas12a orthologs with optimized crRNA scaffolds. Genome Biology 20(1): 15. 6 pages (2019).
Third Party Observations filed on Oct. 15, 2018 in UK patent application No. GB 1804822.3 (18 pages).
U.S. Appl. No. 16/281,939 Office Action dated Nov. 10, 2020.
U.S. Appl. No. 16/577,696 Final Office Action dated Sep. 9, 2020.
U.S. Appl. No. 16/577,696 Office Action dated Apr. 22, 2020.
U.S. Appl. No. 16/577,740 Final Office Action dated Sep. 8, 2020.
U.S. Appl. No. 16/577,740 Office Action dated Apr. 22, 2020.
Wahlestedt et al. Potent and nontoxic antisense oligonucleotides containing locked nucleic acids. PNAS USA 97:5633-5638 (2000).
Wang et al.: Cyclohexene Nucleic Acids (CeNA): Serum Stable Oligonucleotides that Activate RNase H and Increase Duplex Stability with Complementary RNA. J. Am. Chem. Soc. 122(36): 8595-8602 (2000).
Weintraub, K.: Biomedicine: The new gold standard. Nature. 495(7440): S14-S16 (2013).
Xia et al.: Colorimetric detection of DNA, small molecules, proteins, and ions using unmodified gold nanoparticles and conjugated polyelectrolytes. Proc Natl Acad Sci U S A. 107(24): 10837-10841 (2010).
Xie et al.: Optimization of a Microfluidic Cartridge for Lab-on-a-Chip (LOG) Application and Bio-Testing for DNA/RNA Extraction. 2008 58th Electronic Components and Technology Conference. 1310-1316 (2008).
Xu et al.: A gold-nanoparticle-based real-time colorimetric screening method for endonuclease activity and inhibition. Angew Chem Int Ed Engl. 46(19): 3468-3470 (2007).
Yan et al. (2018) Cas13d Is a Compact RNA-Targeting Type VI CRISPR Effector Positively Modulated by a WYL-Domain-Containing Accessory Protein. Molecular Cell, 70(2):327-339 (Year: 2018).
Yang et al. Using Molecular Beacons for Sensitive Fluorescence Assays of the Enzymatic Cleavage of Nucleic Acids, from: Methods in Molecular Biology, vol. 335: Fluorescent Energy Transfer Nucleic Acid Probes: Designs and Protocols, Edited by V. V. Didenko (Totowa, NJ, Humana Press Inc., 2006), pp. 71-81.
Young et al.: Hollow spherical nucleic acids for intracellular gene regulation based upon biocompatible silica shells. Nano Lett. 12(7): 3867-3871 (2012).
Zangheri et al.: Microfluidic cartridge with integrated array of amorphous silicon photosensors for chemiluminescence detection of viral DNA. Sensing and Bio-Sensing Research 7: 127-132 (2016).
Zanoli et al. Isothermal Amplification Methods for the Detection of Nucleic Acids in Microfluidic Devices. Biosensors 3:18-43 (2013).
Zetsche et al. Cpf1 is a single RNA-guided endonuclease of a class 2 CRISPR-Cas system. Cell 163:759-771 (2015).
Zhang et al.: A Strategy for increasing drug solubility and efficacy through covalent attachment to polyvalent DNA-nanoparticle conjugates. ACS Nano.5(9): 6962-6970 (2011).
Zhang, et al. Antibody-linked spherical nucleic acids for cellular targeting. JACS, 2012, vol. 134, Issue 40, pp. 16488-16491.
Zhang et al. Design of a Molecular Beacon DNA Probe with Two Fluorophores. Angewandte Chemi, 113.2 (2001): 416-419.
Zhang, et al., PowerBLAST: A New Network BLAST Application for Interactive or Automated Sequence Analysis and Annotation, Genome Res. 1997, 7:649-656.
Zheng et al.: Topical delivery of siRNA-based spherical nucleic acid nanoparticle conjugates for gene regulation. Proc Natl Acad Sci U S A.109(30): 11975-11980 (2012).
Zhong et al.: Improving Plant Genome Editing with High-Fidelity xCas9 and Non-canonical PAM-Targeting Cas9-NG. Molecular Plant 12(7): 1027-1036 (2019).
U.S. Appl. No. 16/896,371 Non-Final Office Action dated Mar. 19, 2021.
U.S. Appl. No. 16/927,351 Final Office Action dated May 14, 2021.
U.S. Appl. No. 16/927,351 Non-Final Office Action dated Mar. 9, 2021.
U.S. Appl. No. 17/037,594 Final Office Action dated Jun. 15, 2021.
U.S. Appl. No. 16/577,696 Non-Final Office Action dated Sep. 20, 2021.
U.S. Appl. No. 16/577,740 Non-Final Office Action dated Sep. 21, 2021.
U.S. Appl. No. 17/229,272 Non-Final Office Action dated Oct. 22, 2021.

* cited by examiner

FIG. 14A
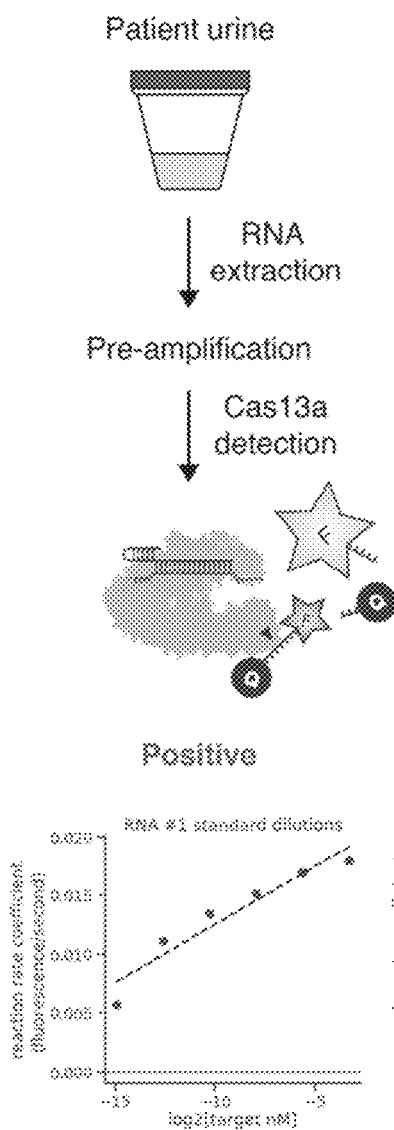
FIG. 14B
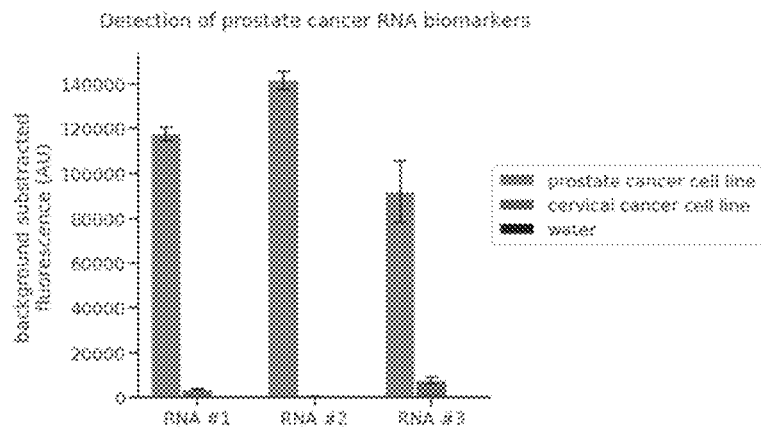
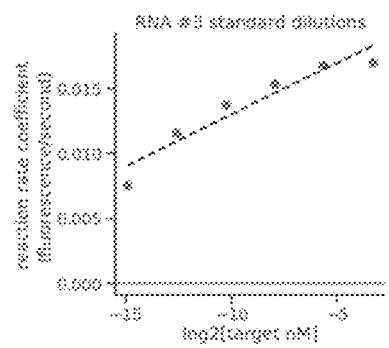
FIG. 14C

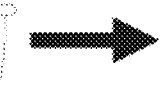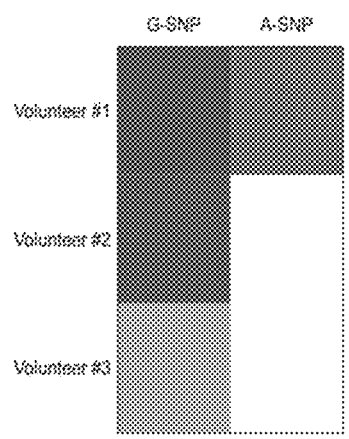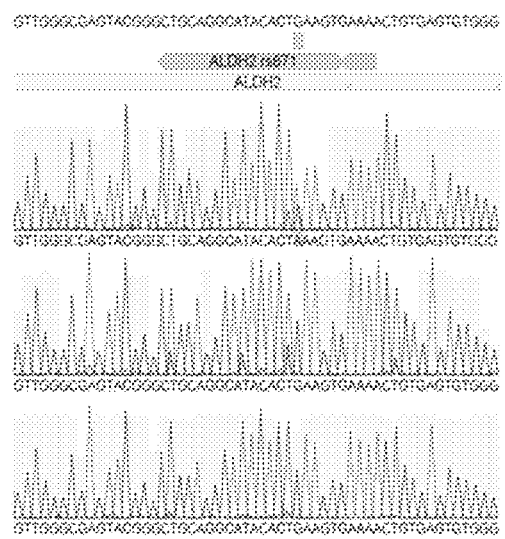
FIG. 16A
FIG. 16B
FIG. 16C
FIG. 16D
FIG. 16E FIG. 18A
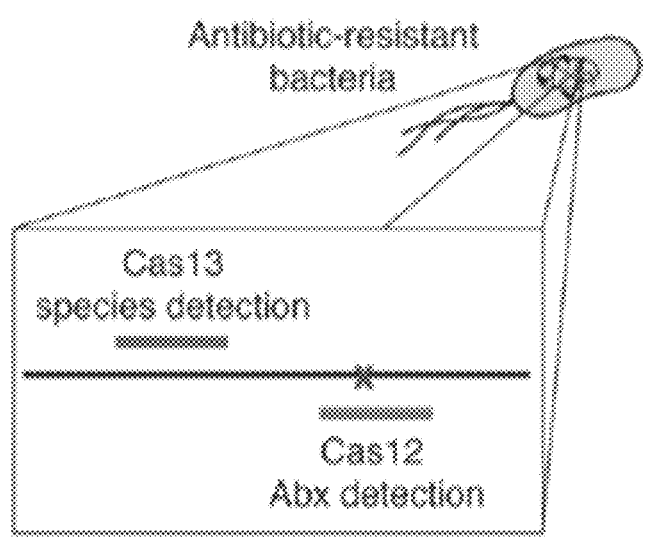
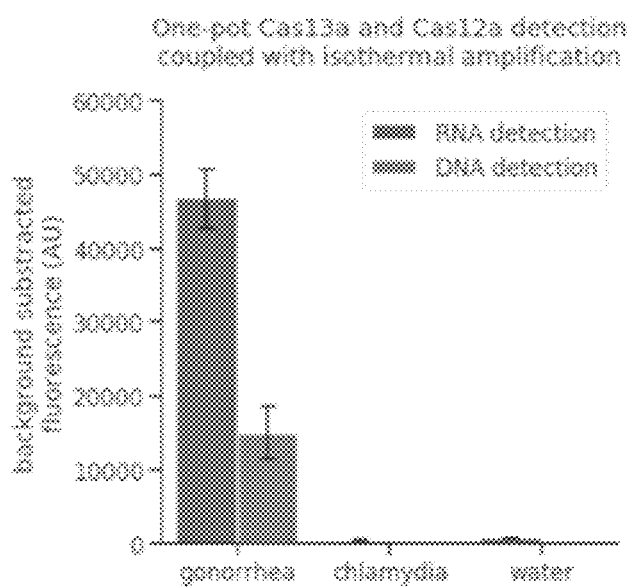
FIG. 18B
FIG. 19A
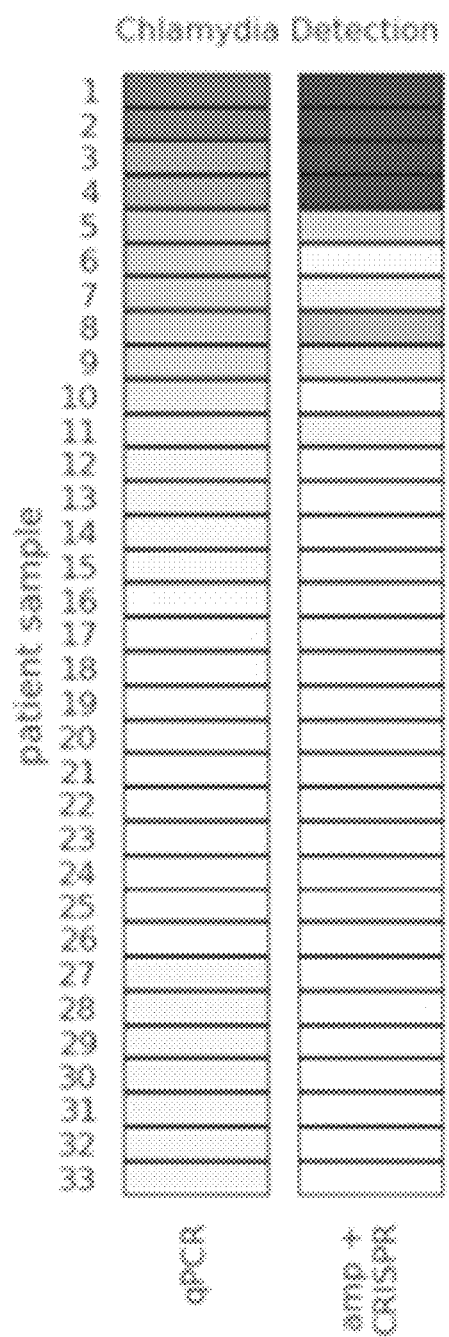

FIG. 21A
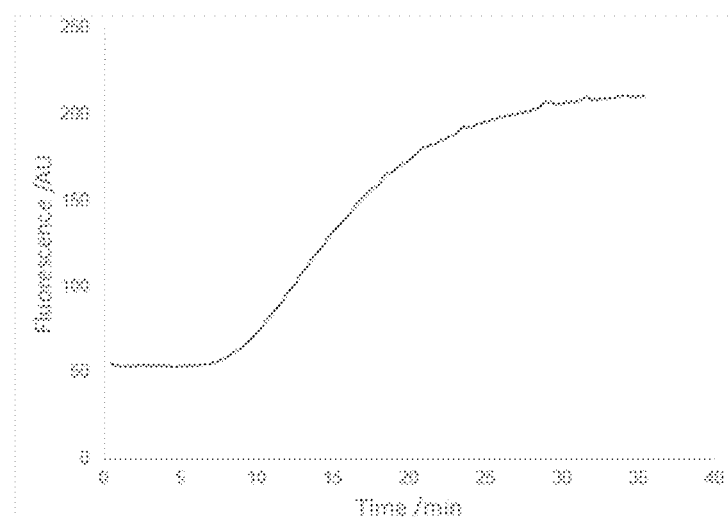
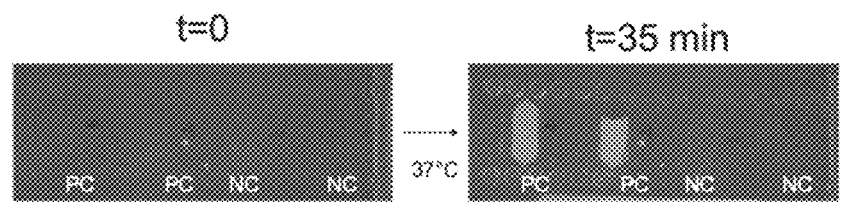
FIG. 21B
FIG. 21C
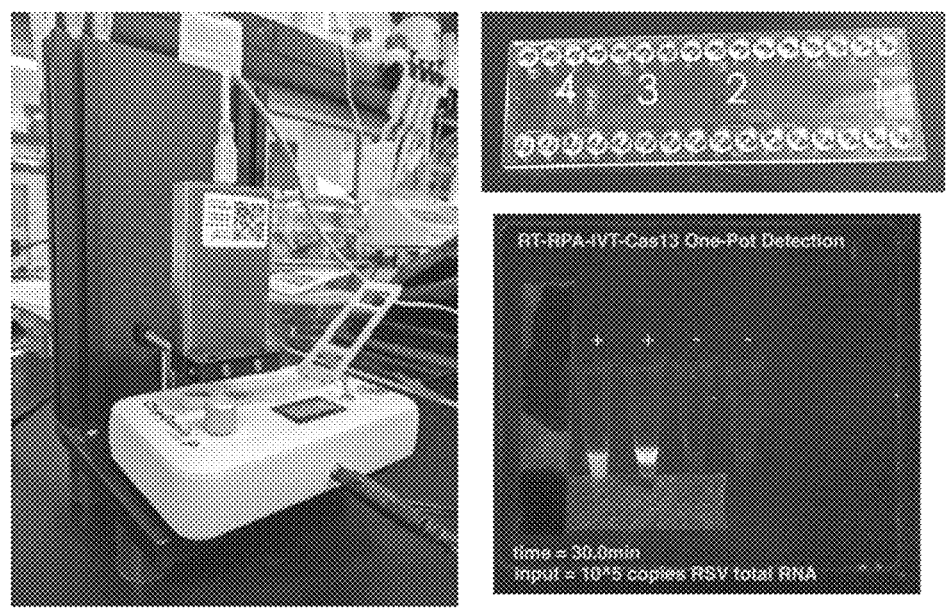

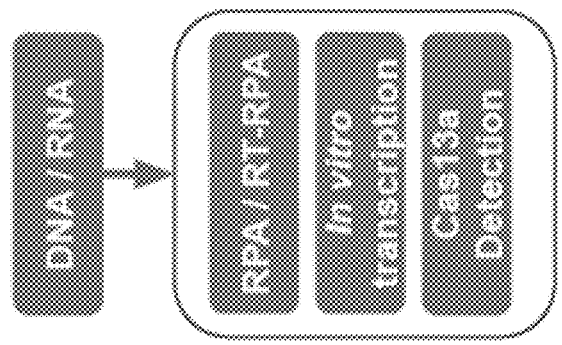
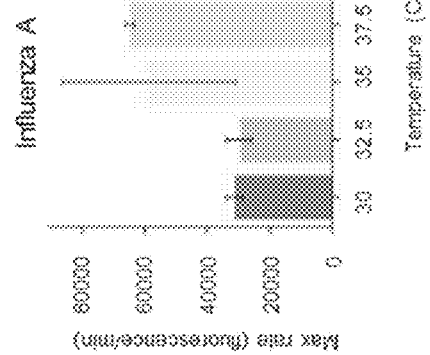
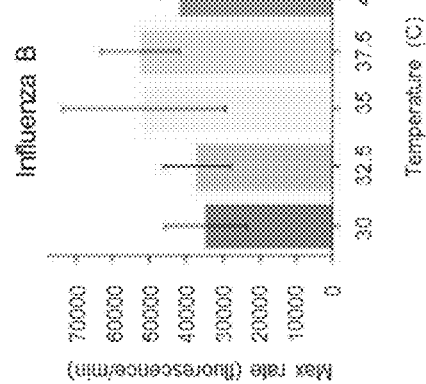
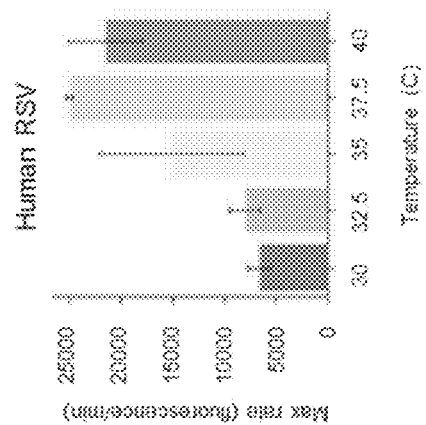
FIG. 39A  FIG. 39B  FIG. 39C  FIG. 39D
FIG. 39

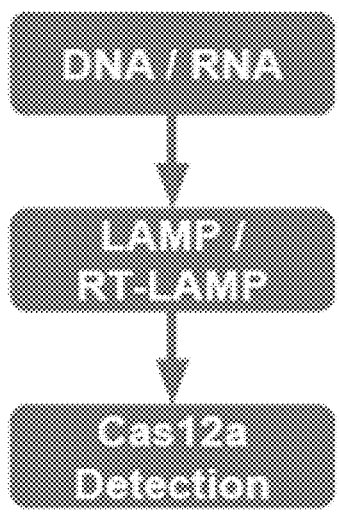
FIG. 40A
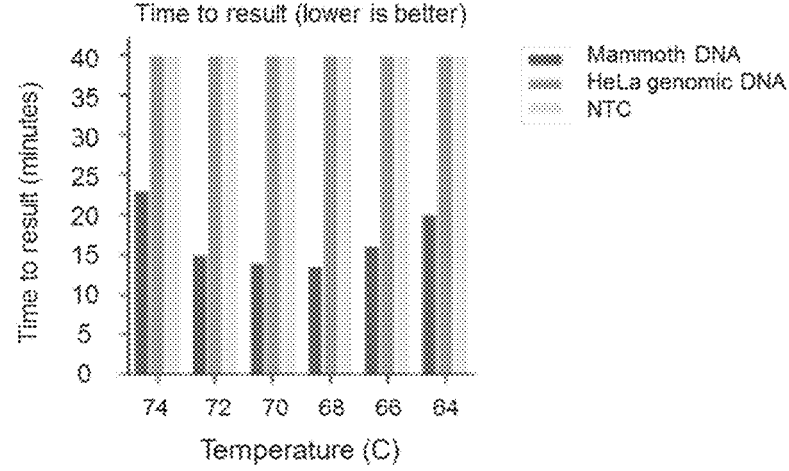
FIG. 40B
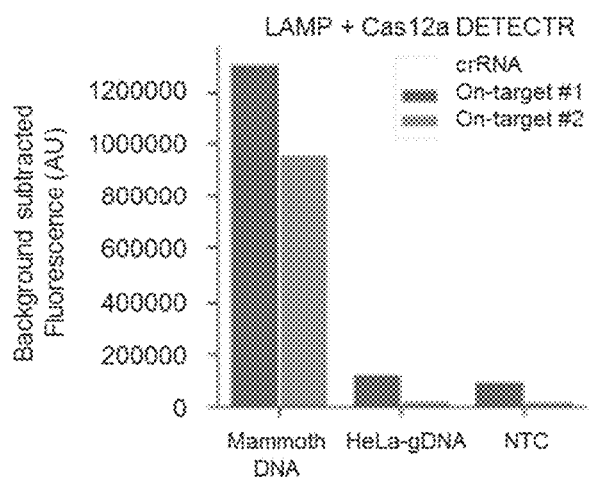
FIG. 40C
FIG. 40

FIG. 41A
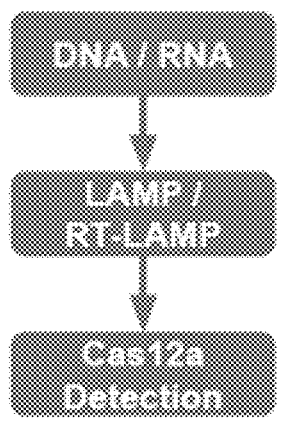
FIG. 41B
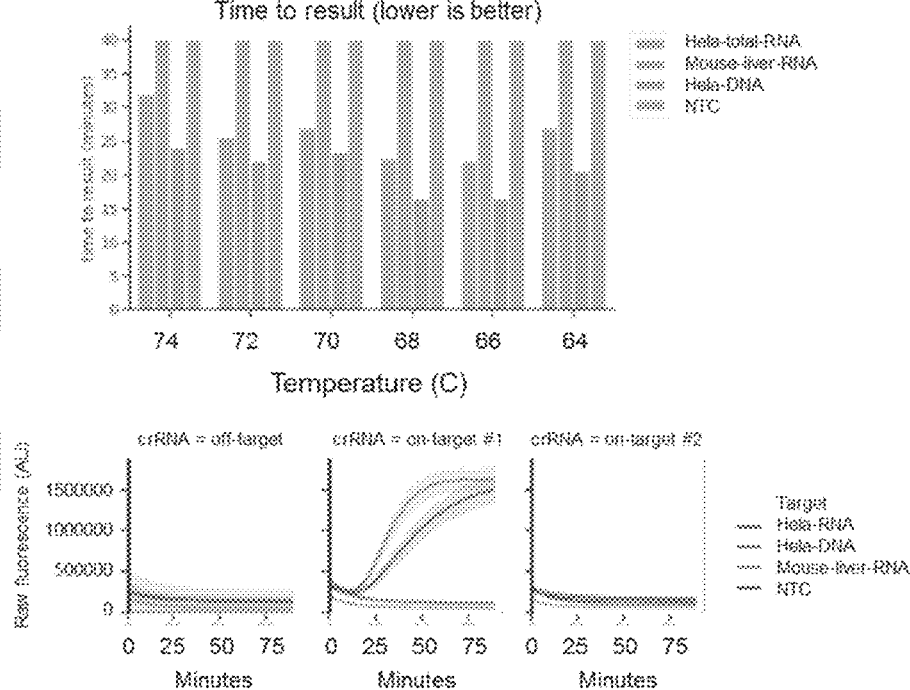
FIG. 41C
FIG. 41

FIG. 45A
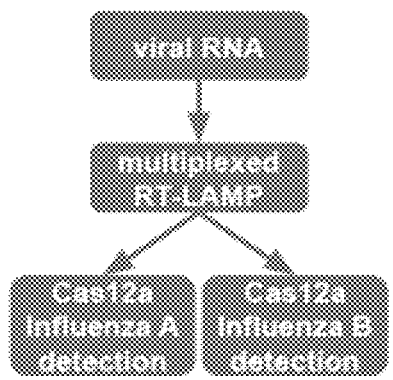
FIG. 45B
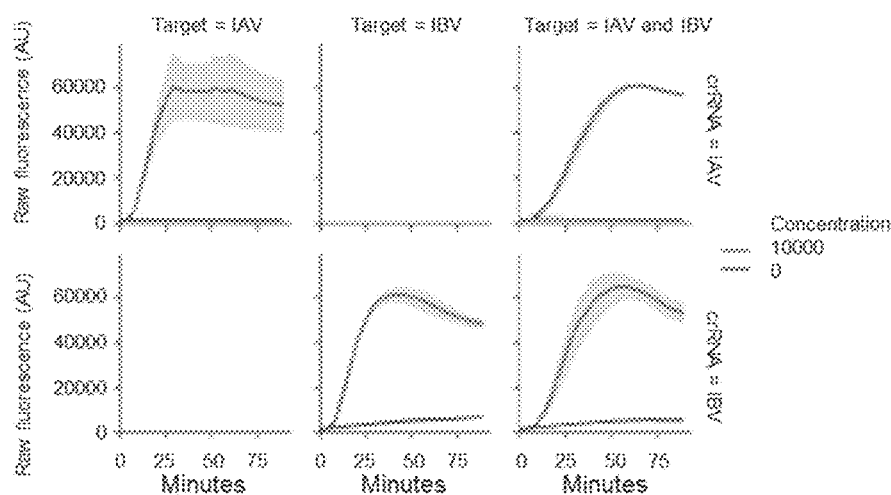
FIG. 45C
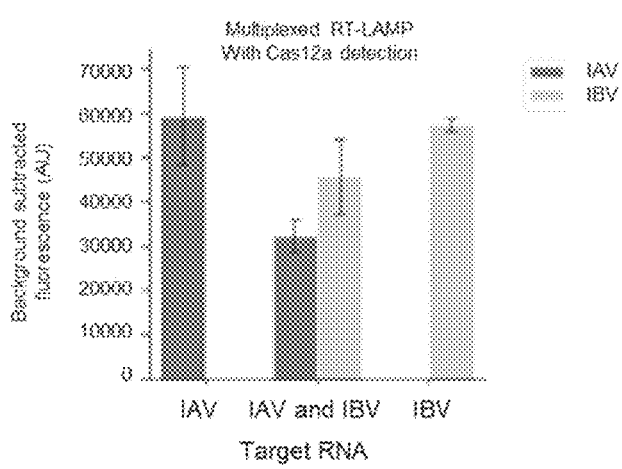
FIG. 45

FIG. 47

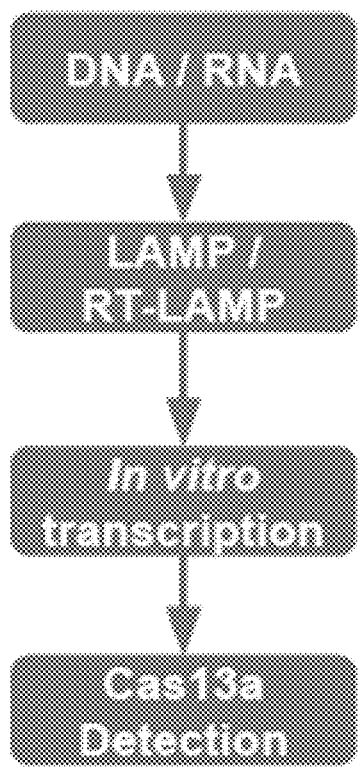
FIG. 48A
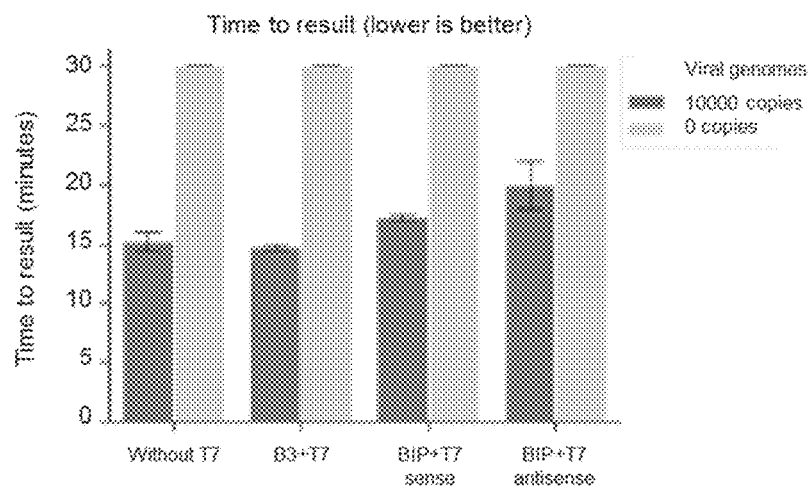
FIG. 48B
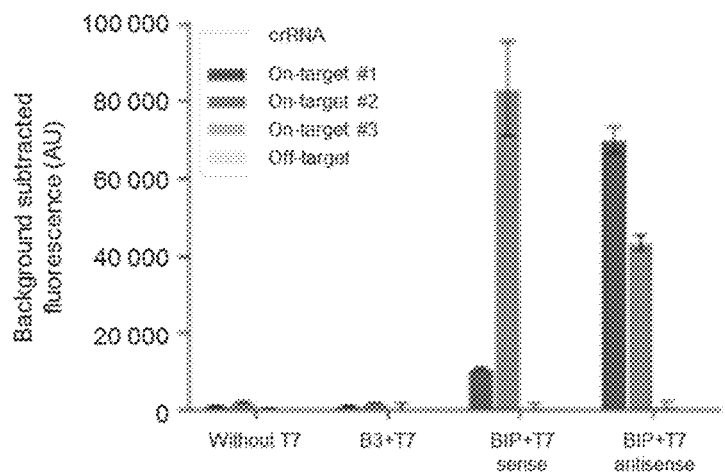
FIG. 48C
FIG. 48

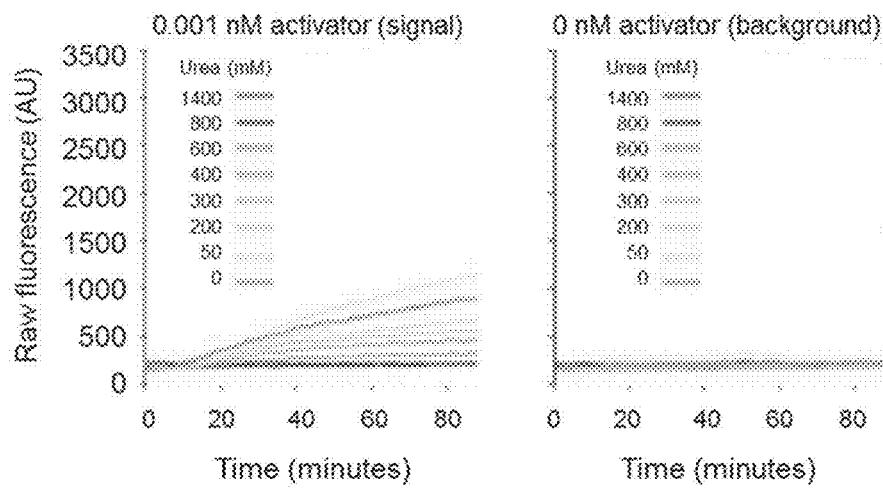
FIG. 51A
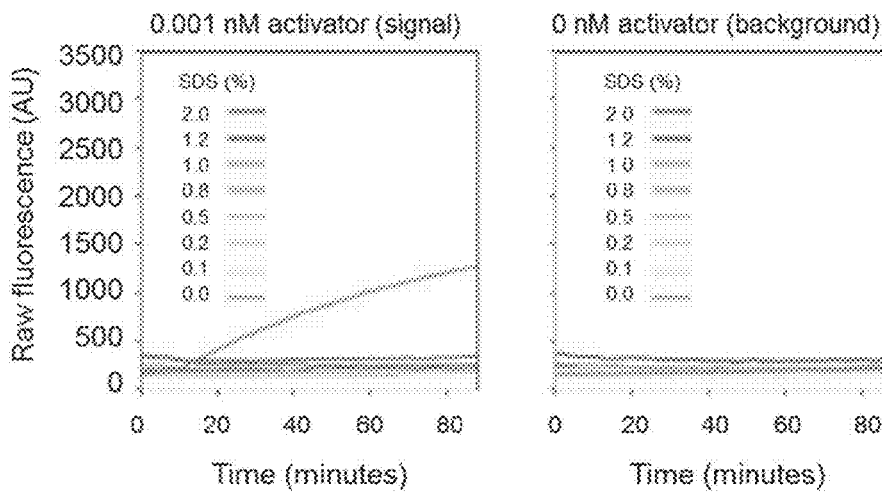
FIG. 51B
FIG. 51

FIG. 69A
FIG. 69B
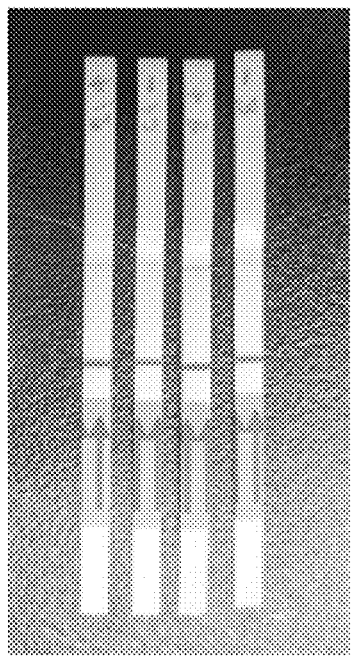
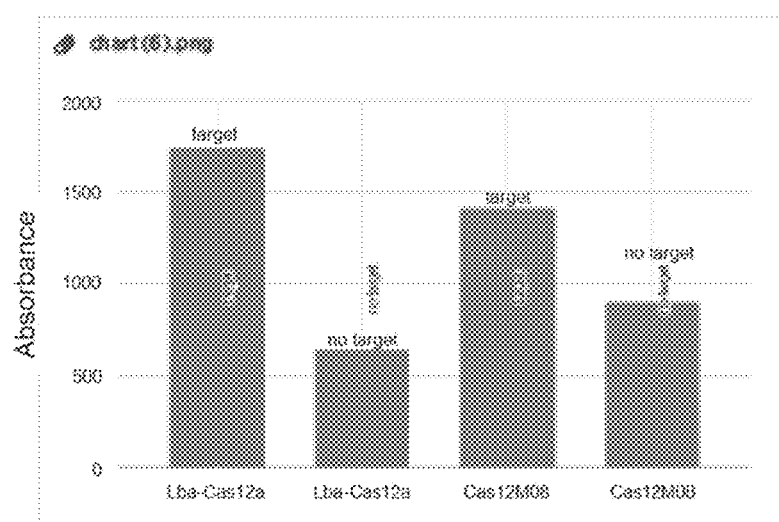
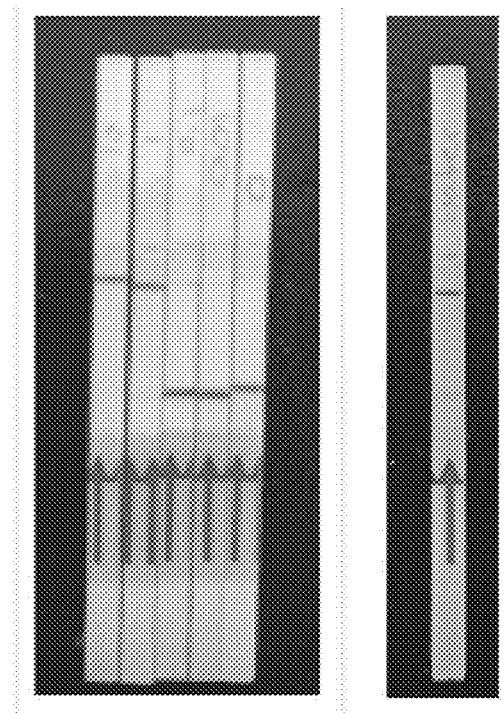
FIG. 69C

FIG. 83A
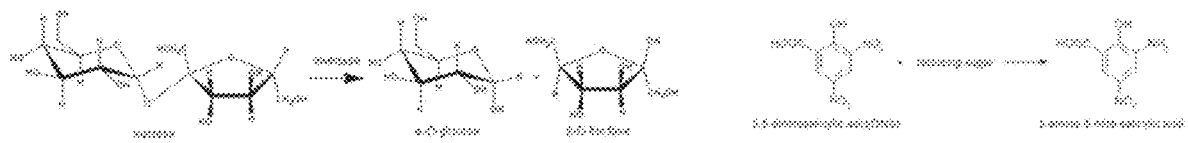
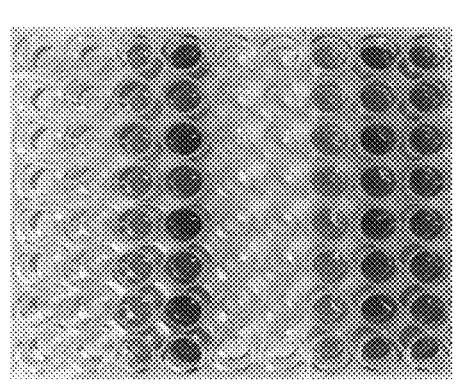
FIG. 83B
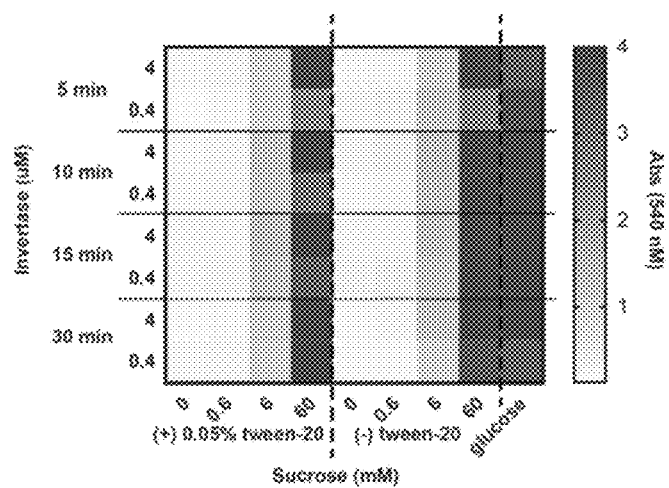
FIG. 83C

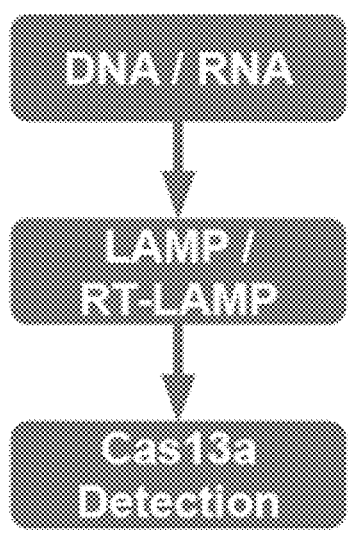
FIG. 92A
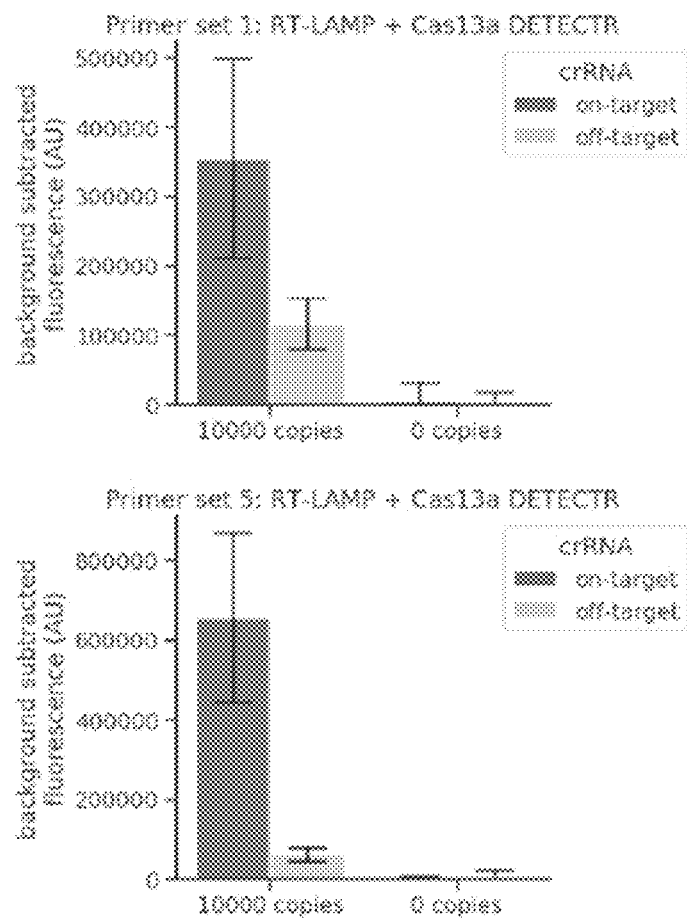
FIG. 92B
FIG. 92C
FIG. 92

FIG. 95A
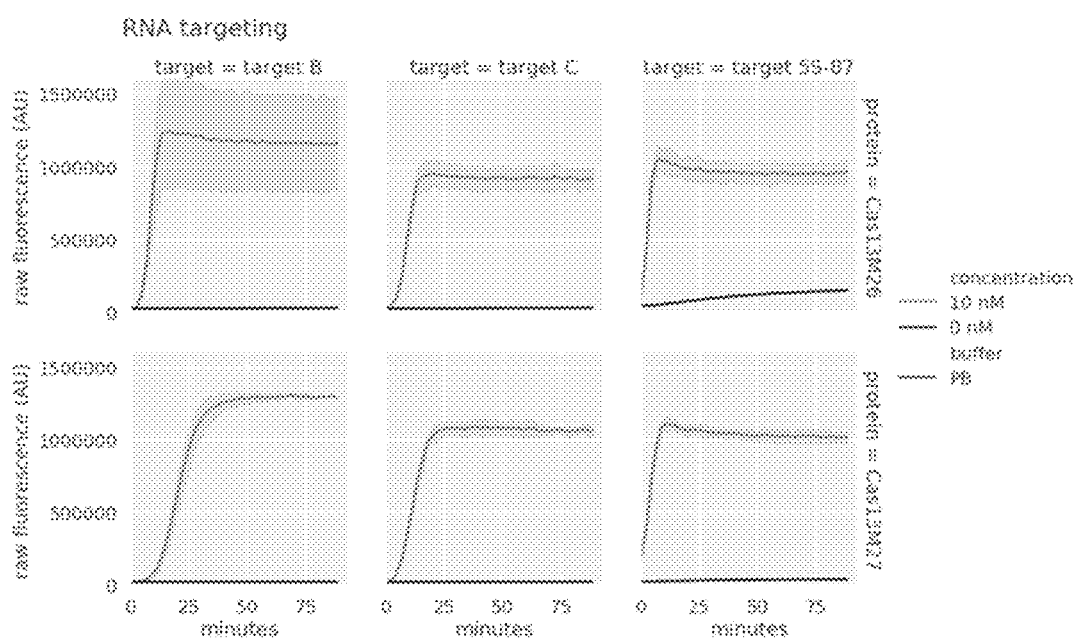
FIG. 95B
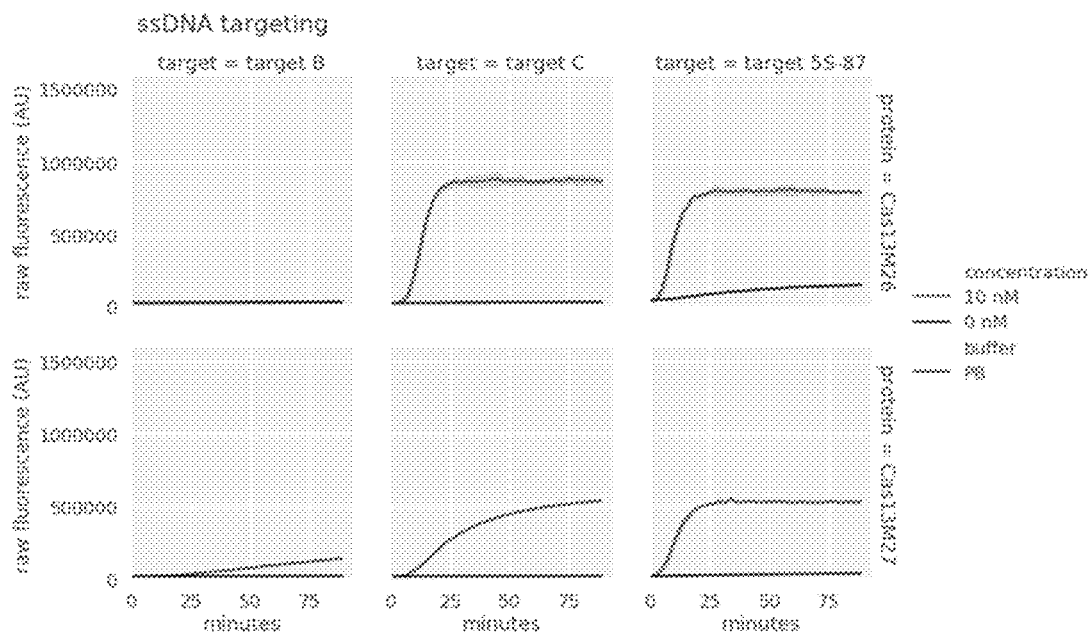
FIG. 95

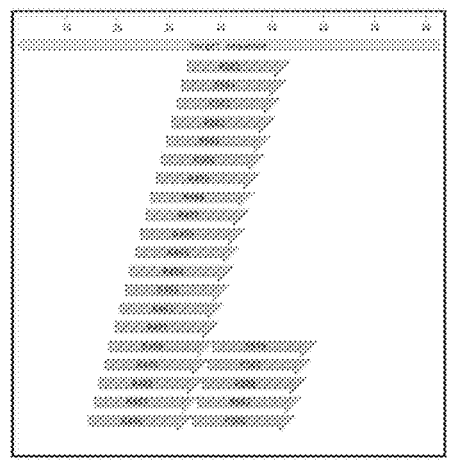
FIG. 97A
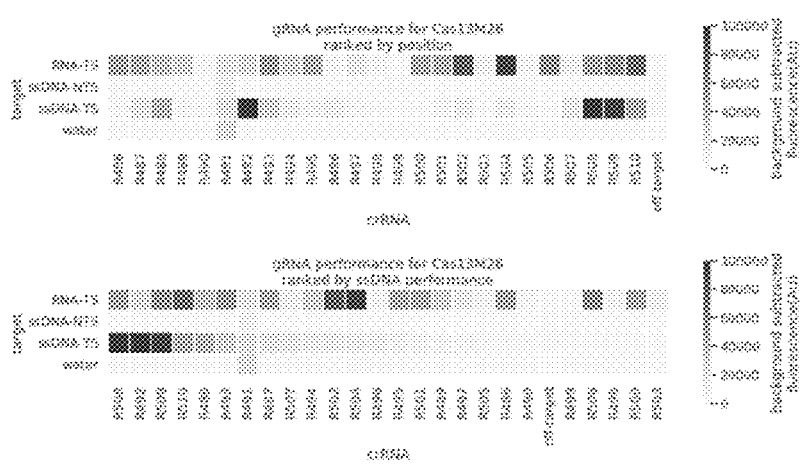
FIG. 97B
FIG. 97C
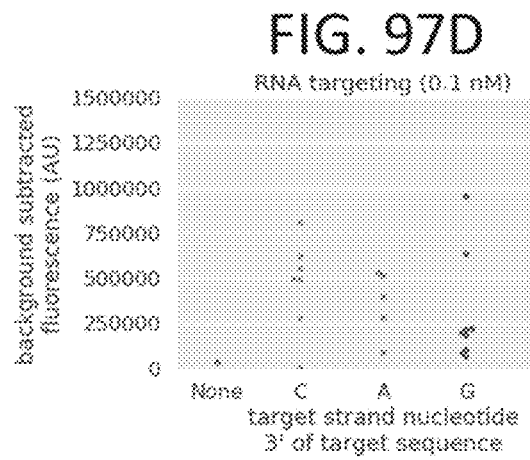
FIG. 97D
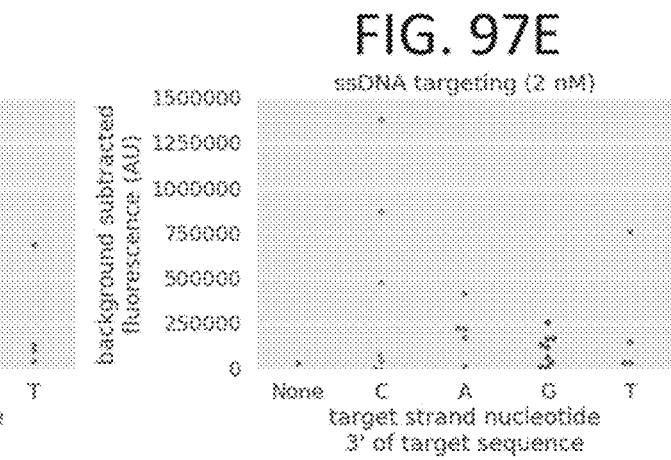
FIG. 97E
FIG. 97

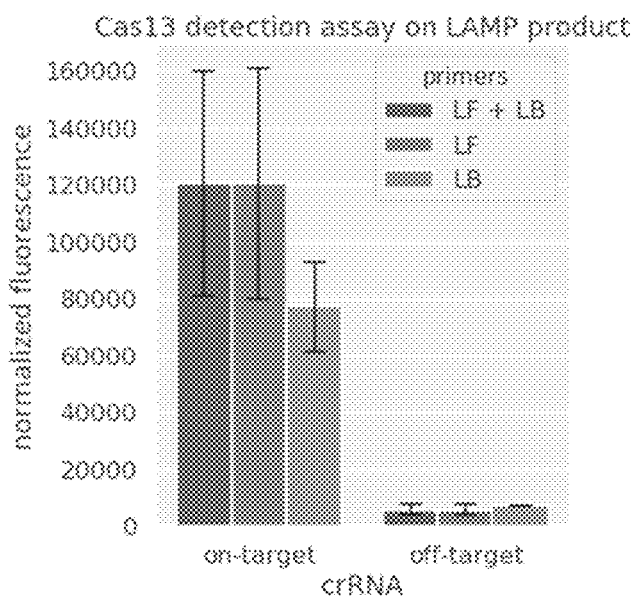
FIG. 98A
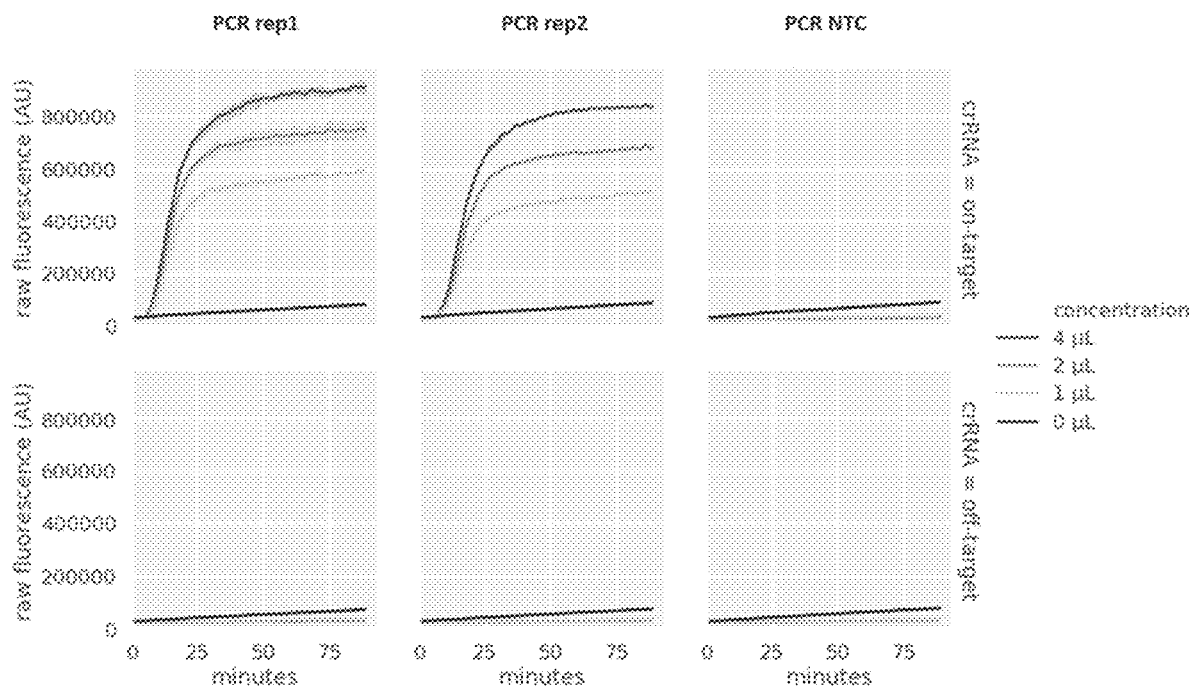
FIG. 98B
FIG. 98

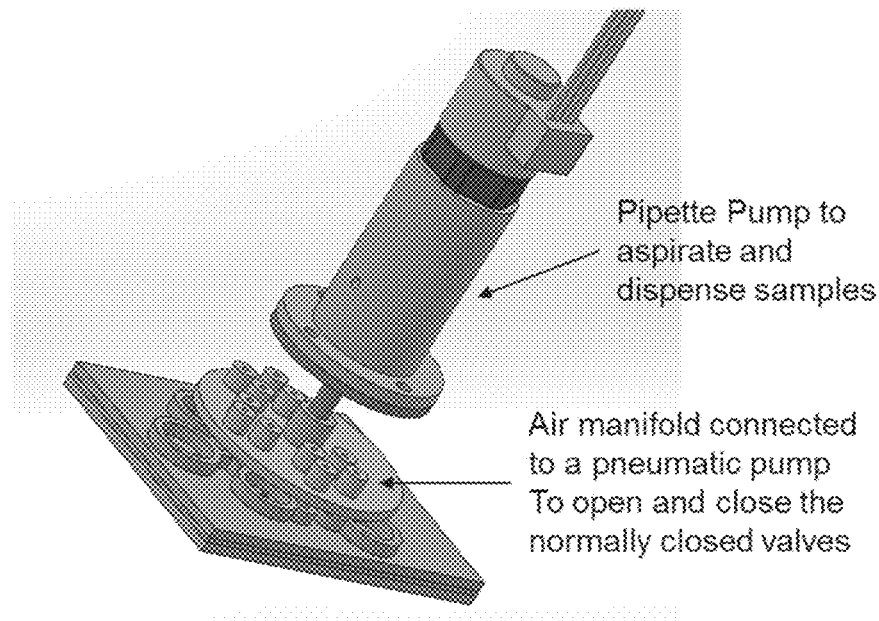
FIG. 100A
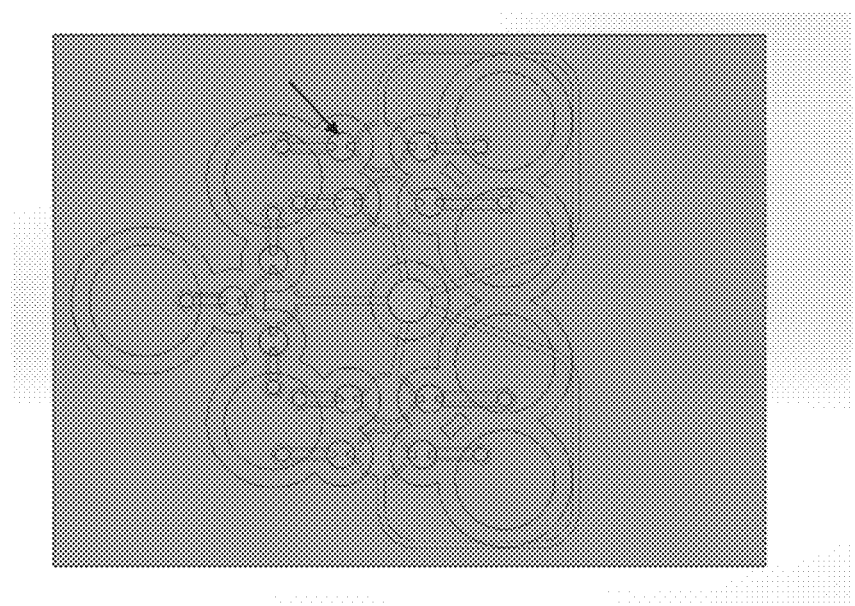
FIG. 100B
FIG. 100

(i.)

(ii.)

(iii.)

(iv.)

(v.)

PROGRAMMABLE NUCLEASE COMPOSITIONS AND METHODS OF USE THEREOF

CROSS-REFERENCE TO RELATED APPLICATIONS

This application is a continuation of PCT International Application No. PCT/US2019/044763, which claims priority to and benefit from U.S. Provisional Application No. 62/713,379 filed Aug. 1, 2018; 62/722,024, filed Aug. 23, 2018; 62/787,123 filed Dec. 31, 2018; 62/788,701 filed Jan. 4, 2019; 62/788,702 filed Jan. 4, 2019; 62/863,184 filed Jun. 18, 2019; and 62/879,332, filed Jul. 26, 2019, the entire contents of each of which are herein incorporated by reference.

SEQUENCE LISTING

The instant application contains a Sequence Listing which has been submitted electronically in ASCII format and is hereby incorporated by reference in its entirety. Said ASCII copy, created on Sep. 13, 2019, is named 53694-705_601_SL.txt and is 756,967 bytes in size.

BACKGROUND

Ailments, such as cancer, genetic disorders, or communicable diseases, can be difficult to detect. Various communicable diseases can easily spread from an individual or environment to an individual. These diseases may include but are not limited to human immunodeficiency virus (HIV), human papillomavirus (HPV), *chlamydia*, gonorrhea, syphilis, trichomoniasis, sexually transmitted infection, malaria, Dengue fever, Ebola, chikungunya, and leishmaniasis. Individuals with one or more of these ailments may have poor outcomes, including severe symptoms that can lead to death. The detection of the ailments, especially at the early stages of disease or infection, may provide guidance on treatment or intervention to reduce the progression or transmission of the ailment.

SUMMARY

In various aspects, the present disclosure provides a device for measuring a signal comprising: i) a first chamber comprising a sample and a buffer for lysing the sample; ii) a second chamber, fluidically connected by a first pneumatic valve to the first chamber, wherein the second chamber comprises a programmable nuclease and a reporter comprising a nucleic acid and a detection moiety, and wherein the second chamber is coupled to a measurement device for measuring the signal from the detection moiety produced by cleavage of the nucleic acid of the reporter.

In some aspects, the device further comprises: iii) a third chamber fluidically connected by the first pneumatic valve to the first chamber and connected by a second pneumatic valve to the second chamber. In some aspects, the first pneumatic valve fluidically connecting the first chamber and the second chamber comprises a first channel adjacent to a first microfluidic channel connecting the first chamber and the second chamber. In some aspects, the first pneumatic valve fluidically connecting the first chamber and the third chamber comprises a second channel adjacent to a second microfluidic channel connecting the first chamber and the third chamber. In some aspects, the second pneumatic valve fluidically connecting the second chamber and the third chamber comprises a third channel adjacent to a third microfluidic channel connecting the second chamber and the third chamber.

In some aspects, the first channel, the second channel, or the third channels are connected to an air manifold. In some aspects, more than one chamber comprising a programmable nuclease and a reporter are fluidically connected to a single chamber comprising the sample. In some aspects, more than one chamber comprising a programmable nuclease and a reporter are fluidically connected to a single chamber comprising a forward primer, a reverse primer, a dNTP, and a polymerase.

In various aspects, the present disclosure provides a device for measuring a signal comprising: a sliding layer comprising a channel with an opening at a first end of the channel and an opening at a second end of the channel; and a fixed layer comprising: i) a first chamber having an opening; ii) a second chamber having an opening, wherein the second chamber comprises a programmable nuclease and a reporter comprising a nucleic acid and a detection moiety; iii) a first side channel having an opening aligned with the opening of the first chamber; and iv) a second side channel having an opening aligned with the opening of the second chamber, wherein the sliding layer and the fixed layer move relative to each other to fluidically connect the first chamber and the first side channel via the opening at the first end of the channel, the opening at the second end of the channel, the opening of the first chamber, and the opening of the first side channel, and wherein the sliding layer and the fixed layer move relative to each other to fluidically connect the second chamber and the second side channel via the opening at the first end of the channel, the opening at the second end of the channel, the opening of the second chamber, and the opening of the second side channel.

In some aspects, the fixed layer further comprises i) a third chamber having an opening; and ii) a third side channel having an opening aligned with the opening of the third chamber, wherein the sliding layer and the fixed layer move relative to each other to fluidically connect the third chamber and the third side channel via the opening at the first end of the channel, the opening at the second end of the channel, the opening of the third chamber, and the opening of the third side channel. In some aspects, the second chamber is coupled to a measurement device for measuring the signal from the detection moiety produced by cleavage of the nucleic acid of the reporter. In some aspects, the opening of the first end of the channel overlaps with the opening of the first chamber and the opening of the second end of the channel overlaps with the opening of the first side channel.

In some aspects, the opening of the first end of the channel overlaps with the opening of the second chamber and the opening of the second end of the channel overlaps with the opening of the second side channel. In some aspects, the opening of the first end of the channel overlaps with the opening of the third chamber and the opening of the second end of the channel overlaps with the opening of the third channel. In some aspects, the first side channel, the second side channel, and the third side channel are fluidically connected to a mixing chamber.

In some aspects, the third chamber comprises a forward primer, a reverse primer, a dNTP, an NTP, a polymerase, a reverse transcriptase, a T7 polymerase, or any combination thereof. In some aspects, the forward primer, the reverse primer, or both comprises a T7 promoter. In some aspects, the second chamber comprises a guide nucleic acid. In some aspects, the programmable nuclease, the reporter, the guide nucleic acid, the forward primer, the reverse primer, the dNTP, the NTP, the polymerase, the reverse transcriptase, the T7 promoter, the T7 polymerase, or any combination thereof is lyophilized or vitrified.

In some aspects, the second chamber is optically connected to a spectrophotometric measurement device or a fluorescence measurement device. In some aspects, the second chamber comprises a metal lead adapted for measurement of a change in current. In some aspects, the first chamber holds a volume of about 200 µL, the second chamber holds a volume of about 20 µL, and the third chamber holds a volume of about 20 µL. In some aspects, the second chamber comprises a plurality of guide RNAs.

In some aspects, the device comprises from 2 to 20 chambers comprising a programmable nuclease, a guide nucleic acid, and a reporter, wherein a detection chamber of the from 2 to 20 chambers comprises a unique guide nucleic acid. In some aspects, the reporter is a hybrid reporter having at least one ribonucleotide and at least one deoxyribonucleotide. In some aspects, the reporter is immobilized to a surface. In some aspects, the surface is a surface of the first chamber or a surface of a bead.

In various aspects, the present disclosure provides a device comprising: a chamber comprising i) a programmable nuclease; and ii) an immobilized reporter comprising a nucleic acid, an affinity molecule, and a detection moiety; and a lateral flow strip comprising: i) a first region comprising a capture molecule specific for the affinity molecule; and ii) a second region comprising an antibody, wherein the first region is upstream of the second region and the chamber is upstream of the lateral flow strip and wherein the first molecule binds to the second molecule.

In some aspects, the first molecule is conjugated to a 3' end or a 5' end of the nucleic acid, and wherein the first molecule is directly conjugated to the detection moiety. In some aspects, the detection moiety comprises a fluorophore. In some aspects, the antibody on the second region is specific for an antibody-coated nanoparticle. In some aspects, the antibody-coated nanoparticle binds the fluorophore. In some aspects, the chamber further comprises a second immobilized reporter comprising a second nucleic acid, a second detection moiety, and the first molecule.

In some aspects, the first molecule is conjugated to a 3' end or a 5' end of the second nucleic acid, and wherein the first molecule is directly conjugated to the second detection moiety. In some aspects, the lateral flow strip comprises a third region comprising a second antibody. In some aspects, the antibody binds the fluorophore and the second antibody binds the second fluorophore. In some aspects, the immobilized reporter, the second immobilized reporter, or both are conjugated to a magnetic bead.

In some aspects, the chamber interfaces with a magnet. In some aspects, the device is connected to a sample prep device comprising a sample chamber, upstream, of an amplification chamber, upstream of the chamber. In some aspects, the sample chamber, the amplification chamber, the reaction chamber, and the lateral flow strip are separated by a substrate. In some aspects, each chamber of the sample prep device comprises a notch preventing fluid flow. In some aspects, the sample prep device comprises a rotatable element and wherein the rotatable element controls fluid flow between chambers.

In various aspects, the present disclosure provides a method of detecting a presence or an absence of a target nucleic acid in a sample, the method comprising: contacting a first volume to a second volume, wherein the first volume comprises the sample and the second volume comprises: i) a guide nucleic acid having at least 10 nucleotides reverse complementary to a target nucleic acid in the sample; and ii) a programmable nuclease activated upon binding of the guide nucleic acid to the target nucleic acid; iii) a reporter comprising a nucleic acid and a detection moiety, wherein the second volume is at least 4-fold greater than the first volume; and detecting the presence or the absence of the target nucleic acid by measuring a signal produced by cleavage of the nucleic acid of the reporter, wherein cleavage occurs when the programmable nuclease is activated.

In various aspects, the present disclosure provides any of the above devices for use in a method of detecting a presence of an absence of a target nucleic acid in a sample, the method comprising: contacting a first volume to a second volume, wherein the first volume comprises the sample and the second volume comprises: i) a guide nucleic acid having at least 10 nucleotides reverse complementary to a target nucleic acid in the sample; and ii) a programmable nuclease activated upon binding of the guide nucleic acid to the target nucleic acid; iii) a reporter comprising a nucleic acid and a detection moiety, wherein the second volume is at least 4-fold greater than the first volume; and detecting the presence or the absence of the target nucleic acid by measuring a signal produced by cleavage of the nucleic acid of the reporter, wherein cleavage occurs when the programmable nuclease is activated.

In various aspects, the present disclosure provides a method comprising of detecting a presence of an absence of a first target nucleic acid, a second target nucleic acid, or both in a sample, the method comprising: contacting the sample to i) a first guide nucleic acid having at least 10 nucleotides reverse complementary to the first target nucleic acid from an organism and a first programmable nuclease activated upon binding of the first guide nucleic acid to the first target nucleic acid; and ii) a second guide nucleic acid having at least 10 nucleotides reverse complementary to the second target nucleic acid from a drug resistant allele of the organism and a second programmable nuclease activated upon binding of the second guide nucleic acid to the second target nucleic acid, wherein the first programmable nuclease and the second programmable nuclease are different; detecting a presence or an absence of the first target nucleic acid by measuring a first signal produced by cleavage of a nucleic acid of a first reporter, wherein cleavage occurs when the first programmable nuclease is activated; and detecting a presence or an absence of the second target nucleic acid by measuring a second signal produced by cleavage of a nucleic acid of the second reporter, wherein cleavage occurs when the second programmable nuclease is activated.

In various aspects, the present disclosure provides any of the above devices for use in a method of detecting a presence of an absence of a first target nucleic acid, a second target nucleic acid, or both in a sample, the method comprising: contacting the sample to i) a first guide nucleic acid having at least 10 nucleotides reverse complementary to the first target nucleic acid from an organism and a first programmable nuclease activated upon binding of the first guide nucleic acid to the first target nucleic acid; and ii) a second guide nucleic acid having at least 10 nucleotides reverse complementary to the second target nucleic acid from a drug resistant allele of the organism and a second programmable nuclease activated upon binding of the second guide nucleic acid to the second target nucleic acid, wherein the first programmable nuclease and the second programmable nuclease are different; detecting a presence or an absence of the first target nucleic acid by measuring a first signal produced by cleavage of a nucleic acid of a first reporter, wherein cleavage occurs when the first programmable nuclease is activated; and detecting a presence or an absence of the second target nucleic acid by measuring a second signal produced by cleavage of a nucleic acid of the second reporter, wherein cleavage occurs when the second programmable nuclease is activated.

In some aspects, the first target nucleic acid and the second target nucleic acid are different. In some aspects, the nucleic acid of the first reporter is a DNA nucleic acid and wherein the nucleic acid of the second reporter is an RNA nucleic acid.

In various aspects, the present disclosure provides a method of detecting a target nucleic acid in a sample, the method comprising: contacting the sample to: i) a guide nucleic acid having at least 10 nucleotides reverse complementary to the target nucleic acid; and ii) a programmable nuclease activated upon binding of the guide nucleic acid to the target nucleic acid; iii) a hybrid reporter comprising a detection moiety and a nucleic acid having at least one ribonucleotide and at least one deoxyribonucleotide; detecting a presence or an absence of the target nucleic acid by measuring a signal produced by cleavage of the nucleic acid of the hybrid reporter, wherein cleavage occurs when the programmable nuclease is activated.

In various aspects, the present disclosure provides any of the above devices for use in a method of detecting a target nucleic acid in a sample, the method comprising: contacting the sample to: i) a guide nucleic acid having at least 10 nucleotides reverse complementary to the target nucleic acid; and ii) a programmable nuclease activated upon binding of the guide nucleic acid to the target nucleic acid; iii) a hybrid reporter comprising a detection moiety and a nucleic acid having at least one ribonucleotide and at least one deoxyribonucleotide; detecting a presence or an absence of the target nucleic acid by measuring a signal produced by cleavage of the nucleic acid of the hybrid reporter, wherein cleavage occurs when the programmable nuclease is activated.

In various aspects, the present disclosure provides a method for identifying a treatment for a subject comprising: measuring a signal by: contacting a sample comprising a target nucleic acid from the subject to: i) a guide nucleic acid having at least 10 nucleotides reverse complementary to the target nucleic acid; and ii) a programmable nuclease activated upon binding of the guide nucleic acid to the target nucleic acid; iii) a reporter comprising a nucleic acid and a detection moiety; and measuring the signal produced by cleavage of the nucleic acid of the reporter, wherein cleavage occurs when the programmable nuclease is activated; and identifying the treatment to administer to the subject.

In various aspects, the present disclosure provides any of the above devices for use in a method for identifying a treatment for a subject comprising: measuring a signal by: contacting a sample comprising a target nucleic acid from the subject to: i) a guide nucleic acid having at least 10 nucleotides reverse complementary to the target nucleic acid; and ii) a programmable nuclease activated upon binding of the guide nucleic acid to the target nucleic acid; iii) a reporter comprising a nucleic acid and a detection moiety; and measuring the signal produced by cleavage of the nucleic acid of the reporter, wherein cleavage occurs when the programmable nuclease is activated; and identifying the treatment to administer to the subject.

In some aspects, the sample is in a first volume and wherein the guide nucleic acid, the programmable nuclease, and the reporter are in a second volume. In some aspects, the second volume is at least 4-fold greater than the first volume. In some aspects, the second volume is at least 10-fold greater than the first volume. In some aspects, the reporter is a hybrid reporter having at least one ribonucleotide and at least one deoxyribonucleotide.

In some aspects, the method comprises amplifying the target nucleic acid, reverse transcribing the target nucleic acid, in vitro transcription of the target nucleic acid, or any combination thereof. In some aspects, the amplifying comprises using a phosphorothioated forward primer, a phosphorothioated reverse primer, or both. In some aspects, the amplifying comprises isothermal amplification. In some aspects, the amplifying comprises thermal amplification.

In some aspects, the amplifying comprises recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), or improved multiple displacement amplification (IMDA), or nucleic acid sequence-based amplification (NASBA). In some aspects, the amplifying comprises recombinase polymerase amplification (RPA). In some aspects, the amplifying comprises loop mediated amplification (LAMP).

In some aspects, the amplifying the target nucleic acid, the reverse transcribing the target nucleic acid, the in vitro transcription of the target nucleic acid, or any combination thereof is in the same reaction as the detecting and the measuring. In some aspects, the method further comprises removing non-target nucleic acids with an exonuclease. In some aspects, the nucleic acid of the reporter is conjugated at its 3' end or 5' end to an affinity molecule, wherein the affinity molecule is directly conjugated to the detection moiety.

In some aspects, the guide nucleic acid, the programmable nuclease, and the reporter are present in a single chamber. In some aspects, the single chamber is fluidically connected to a second chamber via a first pneumatic valve, wherein the second chamber comprises the sample. In some aspects, a third chamber is positioned between the second chamber and the single chamber, wherein the third chamber comprises a dNTP, a forward primer, a reverse primer, and a polymerase. In some aspects, the third chamber is fluidically connected to the single chamber via a second pneumatic valve and wherein the third chamber is fluidically connected to the second chamber via a third pneumatic valve.

In some aspects, the method further comprises: opening the third pneumatic valve and moving 1 to 10 µL of the sample from the second chamber to the third chamber; and opening the second pneumatic valve and moving 1 to 10 µL of the sample from the third chamber to the single chamber, or opening the first pneumatic valve and moving 1 to 10 µL of the sample from the second chamber to the single chamber. In some aspects, the method further comprises incubating the sample in the single chamber for from 1 minute to 10 minutes. In some aspects, the single chamber has an opening.

In some aspects, the single chamber and a second chamber having an opening are positioned in a fixed layer, wherein the second chamber comprises the sample, and wherein the fixed layer is coupled to a sliding layer comprising a channel having a first opening and a second opening. In some aspects, the fixed layer further comprises a third chamber having an opening, wherein the third chamber comprises a dNTP, a forward primer, a reverse primer, and a polymerase. In some aspects, the opening in the second chamber is aligned with an opening in a first side channel, the opening in the third chamber is aligned with an opening in a second side channel, and the opening in the single chamber is aligned with an opening in a third side channel.

In some aspects, the method comprises one or more of the following steps: sliding the sliding layer to overlap the opening of the second chamber with the opening of the channel; moving the sample from the second chamber into the channel; aspirating the sample from the channel into the first side channel and mixing; sliding the sliding layer to overlap the opening of the channel with the opening of the third chamber; dispensing the sample into the third chamber; moving the sample from the third chamber into the channel; aspirating the sample from the channel into the second side channel and mixing; sliding the sliding layer to overlap the opening of the channel with the opening of the single chamber; and dispensing the sample into the single chamber.

In some aspects, the method comprises one or more of the following steps: sliding the sliding layer to overlap the opening of the second chamber with the opening of the channel; moving the sample from the second chamber into the channel; aspirating the sample from the channel into the first side channel and mixing; sliding the sliding layer to overlap the opening of the channel with the opening of the single chamber; and dispensing the sample into the single chamber. In some aspects, the measuring comprises fluorescence imaging, spectrophotometry, or electrochemical measurements.

In some aspects, the programmable nuclease, the reporter, the guide nucleic acid, or any combination thereof are lyophilized or vitrified. In some aspects, the guide nucleic acid comprises from 2 to 20 guide RNAs and wherein a guide RNA of the from 2 to 20 guide RNAs is a unique guide RNA.

In some aspects, the reporter is immobilized to a surface in the single chamber. In some aspects, the surface is a surface of the single chamber or a surface of a bead. In some aspects, the target nucleic acid is from influenza A virus, influenza B virus, RSV, dengue virus, West Nile virus, Hepatitis Virus C, Hepatitis Virus A, Hepatitis Virus B, papillomavirus, HIV, *chlamydia*, gonorrhea, syphilis, trichomoniasis, *borrelia*, zika virus, or a sepsis causing organism.

In some aspects, the programmable nuclease is a programmable Type V CRISPR/Cas enzyme. In some aspects, the programmable Type V CRISPR/Cas enzyme is a programmable Cas12 nuclease. In some aspects, the programmable Cas12 nuclease is Cas12a, Cas12b, Cas12c, Cas12d, or Cas12e.

In some aspects, the programmable Type V CRISPR/Cas enzyme is a programmable Cas14 nuclease. In some aspects, the programmable Cas14 nuclease is Cas14a, Cas14b, Cas14c, Cas14d, Cas14e, Cas14f, Cas14g, or Cas14h. In some aspects, the programmable nuclease is a programmable Type VI CRISPR/Cas enzyme. In some aspects, the programmable Type VI CRISPR/Cas enzyme is a programmable Cas13 nuclease. In some aspects, the programmable Cas13 nuclease is Cas13a, Cas13b, Cas13c, Cas13d, or Cas13e.

In various aspects, the present disclosure provides the use of a programmable nuclease in a device for measuring a signal, wherein the device comprises: i) a first chamber comprising a sample and a buffer for lysing the sample; ii) a second chamber, fluidically connected by a first pneumatic valve to the first chamber, wherein the second chamber comprises the programmable nuclease and a reporter comprising a nucleic acid and a detection moiety, and wherein the second chamber is coupled to a measurement device for measuring the signal from the detection moiety produced by cleavage of the nucleic acid of the reporter.

In various aspects, the present disclosure provides the use of a programmable nuclease in a device for measuring a signal, wherein the device comprises: a sliding layer comprising a channel with an opening at a first end of the channel and an opening at a second end of the channel; and a fixed layer comprising: iii) a first chamber having an opening; iv) a second chamber having an opening, wherein the second chamber comprises the programmable nuclease and a reporter comprising a nucleic acid and a detection moiety; v) a first side channel having an opening aligned with the opening of the first chamber; and vi) a second side channel having an opening aligned with the opening of the second chamber, wherein the sliding layer and the fixed layer move relative to each other to fluidically connect the first chamber and the first side channel via the opening at the first end of the channel, the opening at the second end of the channel, the opening of the first chamber, and the opening of the first side channel, and wherein the sliding layer and the fixed layer move relative to each other to fluidically connect the second chamber and the second side channel via the opening at the first end of the channel, the opening at the second end of the channel, the opening of the second chamber, and the opening of the second side channel.

In various aspects, the present disclosure provides the use of a programmable nuclease in a device for measuring a signal, wherein the device comprises: a chamber comprising i) a programmable nuclease; and ii) an immobilized reporter comprising a nucleic acid, an affinity molecule, and a detection moiety; and a lateral flow strip comprising: i) a first region comprising a capture molecule specific for the affinity molecule; and ii) a second region comprising an antibody, wherein the first region is upstream of the second region and the chamber is upstream of the lateral flow strip and wherein the first molecule binds to the second molecule.

In various aspects, the present disclosure provides the use of a hybrid reporter in a method of detecting a target nucleic acid in a sample, the method comprising: contacting the sample to: i) a guide nucleic acid having at least 10 nucleotides reverse complementary to the target nucleic acid; and ii) a programmable nuclease activated upon binding of the guide nucleic acid to the target nucleic acid; iii) a hybrid reporter comprising a detection moiety and a nucleic acid having at least one ribonucleotide and at least one deoxyribonucleotide; detecting a presence or an absence of the target nucleic acid by measuring a signal produced by cleavage of the nucleic acid of the hybrid reporter, wherein cleavage occurs when the programmable nuclease is activated.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The patent or application file contains at least one drawing executed in color. Copies of this patent or patent application publication with color drawing(s) will be provided by the Office upon request and payment of the necessary fee. The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

FIG. 14A shows for detecting a target nucleic acid in sample of patient urine. First, RNA is extracted from the urine sample. Then the extracted urine undergoes a pre-amplification step in which the target nucleic acid is amplified. The amplicons are then contacted to Cas13 complexed with a guide nucleic that binds to the amplicons, which initiates cleavage of a detector nucleic acid comprising a fluorophore attached to a quencher by a nucleic acid. Upon cleavage of the detector nucleic acid, the fluorophore is detected as a positive signal, indicating the presence of the target nucleic acid in the sample of patient urine.

FIG. 14B shows detection of prostate cancer RNA biomarkers using the workflow of FIG. 14A, except the sample is from a prostate cell cancer line. The y-axis is background fluorescence (AU) and the x-axis indicates the detection of different prostate cancer RNA biomarkers (e.g., RNA #1, RNA #2, and RNA #3). Each RNA was detected in the prostate cancer cell line as indicated by the fluorescence. The same workflow and reagents were applied to a water sample and a sample comprising RNA from a cervical cancer cell line, which were negative controls and showed little to no fluorescence indicating target nucleic acids encoding the prostate cancer RNA biomarkers were not present in the samples as expected.

FIG. 14C shows that the fluorescence output as detected for each prostate cancer RNA biomarker in FIG. 14B is a linear function of the concentration of the target nucleic acid comprising encoding the prostate cancer RNA biomarker.

FIGS. 16A-16E illustrate detection of the alcohol flush SNP.

FIG. 16A illustrates that the workflow for the alcohol flush (ALDH2) SNP detection. A saliva sample is taken from a subject and processed to determine the genotype of the subject.

FIG. 16B shows alcohol flush (ALDH2) SNP detection using Cas12a with a guide nucleic acid for the G-SNP or a guide nucleic acid for the A-SNP in saliva samples from three volunteer subjects, which were spatially multiplexed. Amplification of the ALDH2 gene from human genomic DNA was conducted by PCR followed by incubation with each guide RNA complexed with Cas12a in 20 µl assay volumes. Fluorescence was detected using a plate reader for each sample. Both the G-SNP and A-SNP were detected in the sample from volunteer #1. Only the G-SNP was detected in the samples from volunteer #2 and volunteer #3.

FIG. 16C illustrates the genotype/phenotype correlation for the ALDH2 SNP genotypes.

FIG. 16D shows the genotypes of each volunteer by sequencing (SEQ ID NOS 180, 181, 180 and 180. respectively, in order of appearance), which confirms the genotype detected in FIG. 16B using Cas12a.

FIG. 16E is a table summarizing the parameters of FIG. 16B. TAT: turn around time.

FIG. 18A shows Cas13 and Cas12 multiplexing for detection of a bacteria. Cas13 is used for species detection of the bacteria. Cas12 is used to detect a mutation in a locus of the bacteria that confers antibiotic resistance.

FIG. 18B shows a one-pot Cas13a and Cas12a detection coupled with isothermal amplification for detection of gonorrhea. Nucleic acids from a gonorrhea sample were incubated with Cas13a complexed to guide RNAs for the species (gonorrhea) target nucleic acid for detection of the bacteria species and were incubated with Cas12a complexed to guide RNAs for the antibiotic resistance allele target nucleic acid for detection of the antibiotic resistance allele, using multiplexing. The binding of the gonorrhea target nucleic acids to the Cas13a complexed to guide RNAs for the species target nucleic acids initiates cleavage of a detector nucleic acid comprising a fluorophore attached to a quencher by a nucleic acid. Upon cleavage of the detector nucleic acid, the fluorophore was detected as shown in the graph, indicating gonorrhea was present in the sample. Similarly, the binding of the antibiotic resistance allele target nucleic acids to the Cas12a complexed to guide RNAs for the antibiotic resistance allele target nucleic acids initiates cleavage of a detector nucleic acid comprising a fluorophore attached to a quencher by a nucleic acid. Upon cleavage of the detector nucleic acid, the fluorophore was detected as shown in the graph, indicating the antibiotic resistance allele was present in the sample. Samples with *chlamydia* and water were also tested using the same protocol, and as expected, no fluorescence was detected for either sample.

FIG. 19A shows a comparison of detection for *Chlamydia* in 33 patient samples using either qPCR or amplification paired with a CRISPR enzyme to detect a *Chlamydia* target nucleic acid.

FIG. 21A shows a graph of time in min on the x-axis versus fluorescence (AU) on the y-axis. The graph shows the real-time measurement of fluorescence from a one-pot RT-RTA-IVT-DETECTR reaction carried out on chip.

FIG. 21B shows images of the entire microfluidic chip used for the DETECTR reactions depicted in FIG. 21A under an E-GEL transilluminator. Shown at left is time 0 and shown at right is at time of 35 min.

FIG. 21C shows a photograph of the prototype set-up (left image in figure) of the fluorescence-based readout for the on-chip, one-pot DETECTR reaction of this example, a breadboard prototype (top right image in figure), and a fluorescence image of eppendorf tubes containing the reaction at 30 minutes (bottom right image in figure).

FIG. 39 shows the one-pot Cas13a detection assay at various temperatures.

FIG. 39A shows a schematic of the workflow including providing DNA/RNA and the one-pot reaction including RPA/RT-RPA, in vitro transcription, and Cas13a detection.

FIG. 39B shows a graph of Cas13a detection of Influenza A RNA at various temperatures.

FIG. 39C shows a graph of Cas13a detection of Influenza B RNA at various temperatures.

FIG. 39D shows a graph of Cas13a detection of human RSV (FIG. 39D) RNA at various temperatures.

FIG. 40 shows the optimization of a LAMP reaction for the detection of an internal amplification control using a DNA sequence derived from the Mammuthus *primigenius* (Wooly Mammoth) mitochondria.

FIG. 40A shows a schematic of the workflow including providing DNA/RNA, LAMP/RT-LAMP, and Cas12a detection.

FIG. 40B shows the time to result for LAMP reactions for an internal amplification control using a DNA sequence derived from the Mammuthus *primigenius*, as quantified by fluorescence.

FIG. 40C shows Cas12a specific detection at 37° C. of LAMP amplicon from the 68° C. temperature reaction.

FIG. 41 shows the optimization of LAMP and Cas12 specific detection of the human POP7 gene that is a component of RNase P.

FIG. 41A shows a schematic of the workflow including providing DNA/RNA, LAMP/RT-LAMP, and Cas12a detection.

FIG. 41B shows the time to result of a LAMP/RT-LAMP reaction for RNase P POP7 at different temperatures, as quantified by fluorescence.

FIG. 41C shows three graphs demonstrating Cas12a specific detection at 37° C. of LAMP/RT-LAMP amplicon from the 68° C. temperature reaction.

FIG. 45 shows Cas12a discrimination between amplicons from a multiplex RT-LAMP reaction for Influenza A and Influenza B.

FIG. 45A shows a schematic of the workflow including providing viral RNA, multiplexed RT-LAMP, and Cas12a influenza A detection or Cas12a influenza B detection.

FIG. 45B shows Cas12a detection of RT-LAMP amplicons after 30 minute multiplexed RT-LAMP amplification at 60° C.

FIG. 45C shows background subtracted fluorescence at 30 minutes of Cas12a detection at 37° C. of RT-LAMP amplicons for 10,000 viral genome copies of IAV and IBV.

FIG. 47 shows schematics of LAMP and RT-LAMP primer designs.

FIG. 48 shows that a T7 promoter can be included on the F3 or B3 primers (outer primers), or FIP or BIP primers for Influenza A.

FIG. 48A shows a schematic of the workflow including providing DNA/RNA, LAMP/RT-LAMP, in vitro transcription, and Cas13a detection.

FIG. 48B shows the time to result for RT-LAMP reactions for Influenza A using different primer sets, as quantified by fluorescence.

FIG. 48C shows in vitro transcription (IVT) with T7 RNA polymerase of the product of the RT-LAMP reactions for Influenza A using different primer sets at 37° C. for 10 minutes.

FIG. 51 shows inhibition of Cas13a activity by SDS and urea.

FIG. 51A shows the Cas13a detection assay performed in the presence of 0-200 mM urea.

FIG. 51B shows complete inhibition of Cas13a upon addition of 0.1% or greater amounts of SDS to the reaction (left graph shows with activator and right graph shows without activator).

FIG. 52A shows the results of varying the concentration of NaCl in a Cas13a DETECTR reaction.

FIG. 52B shows the results of varying the concentration of KCl in a Cas13a DETECTR reaction.

FIG. 53A shows varying DTT concentration in NaCl.

FIG. 53B shows varying DTT concentrations in KCl. The orange bar indicates original buffer conditions (50 mM KCl) and no DTT.

FIG. 68 shows the results of evaluating SNP sensitivity along target sequences for Lba-Cas12a.

FIG. 69A shows a photograph of test strips, which from left to right show Lba-Cas12a with target, Lba-Cas12a without target, Cas12M08 with target, and Cas12M08 without target.

FIG. 69B shows a graph of fluorescence on the y-axis for each group tested (Lba-Cas12a with target, Lba-Cas12a without target, Cas12M08 with target, and Cas12M08 without target).

FIG. 69C shows a photograph of various test strips from Cas13M DETECTR assays with 10 nM, 1 nM, 0.1 nM, 0.01 nM, target DNA or no target DNA.

FIG. 74 shows the layout of Milenia HybridDetect strips with the modified Cas reporter.

FIG. 75 shows an example of a single target assay format (to left) and a multiplexed assay format (to right).

FIG. 76 shows another variation of an assay prior to use (top), an assay with a positive result (middle left), an assay with a negative result (middle right), and a failed test (bottom).

FIG. 77 shows one design of a tethered lateral flow Cas reporter.

FIG. 78 shows a workflow for CRISPR diagnostics using the tethered cleavage reporter using magnetic beads.

FIG. 79A shows a FAM-biotin reporter conjugated to magnetic beads, further incubated in the presence or absence of TURBO DNase (Thermo) for 15 minutes at 37 C.

FIG. 79B shows a DIG-biotin reporter, which was conjugated to magnetic beads and incubated in the presence or absence of TURBO DNase (Thermo) for 15 minutes at 37 C.

FIG. 79C shows a schematic of tethered cleavage reporters, which can be used to multiplex readouts fro CRISPR diagnostics (left), and two sample test strips (right).

FIG. 80 shows photographs of test strips where a tethered cleavage reporter was released by CRISPR-Cas proteins.

FIG. 81 shows a schematic for an enzyme-reporter system that is filtered by streptavidin-biotin before reaching the reaction chamber.

Figure 82:
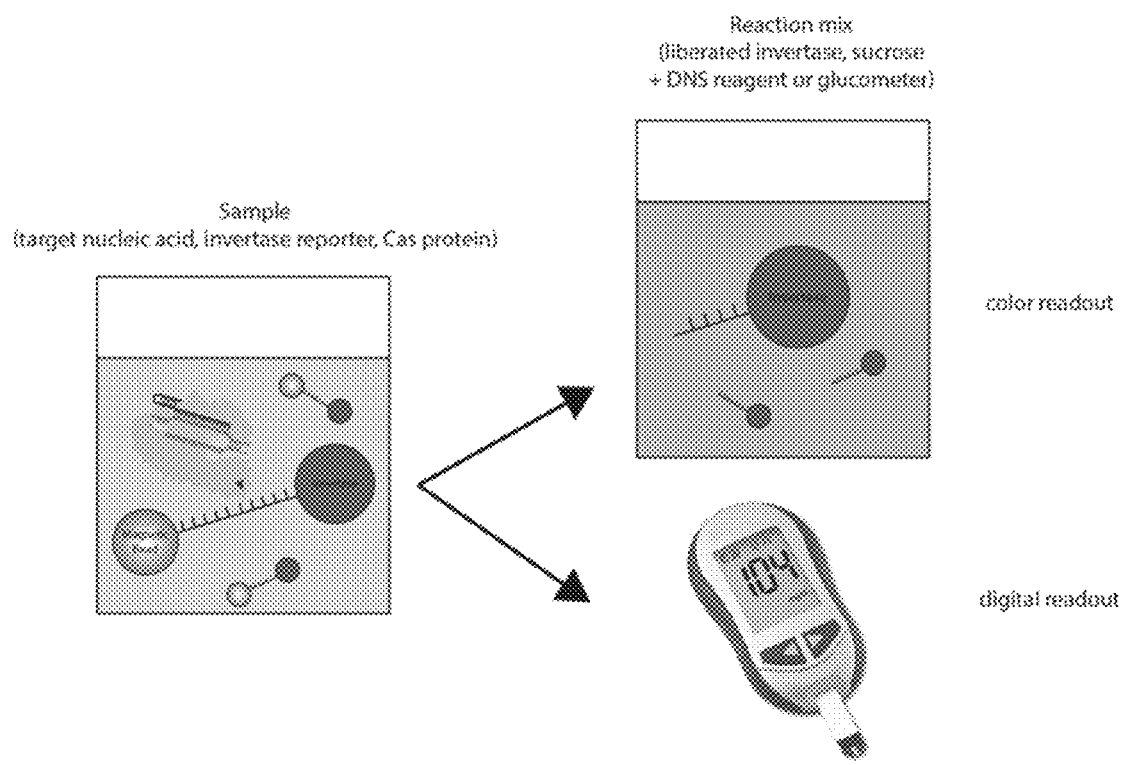

FIG. 82 shows an invertase-nucleic acid used for the detection of a target nucleic acid. The invertase-nucleic acid, immobilized on a magnetic bead, is added to a sample reaction containing Cas protein, guide RNA, and a target nucleic acid. Target recognition activates the Cas protein to cleave the nucleic acid of the invertase-nucleic acid, liberating the invertase enzyme from the immobilized magnetic bead. This solution is either be transferred to the "reaction mix", which contains sucrose and the DNS reagent and changes color from yellow to red when the invertase converts sucrose to glucose or is can be transferred to a hand-held glucometer device for a digital readout.

FIGS. 83A-83C show example color change readout by invertase-nucleic acids in reaction mix. DNS reagent produces a colorimetric change when invertase converts sucrose to glucose. Free invertase at 0.4 or 4 uM was reacted with 0-60 mM sucrose for 5, 10, 15 or 30 min at room temperature, and samples were heated at 95 C for 10 sec to enhance the color change.

Figure 84:
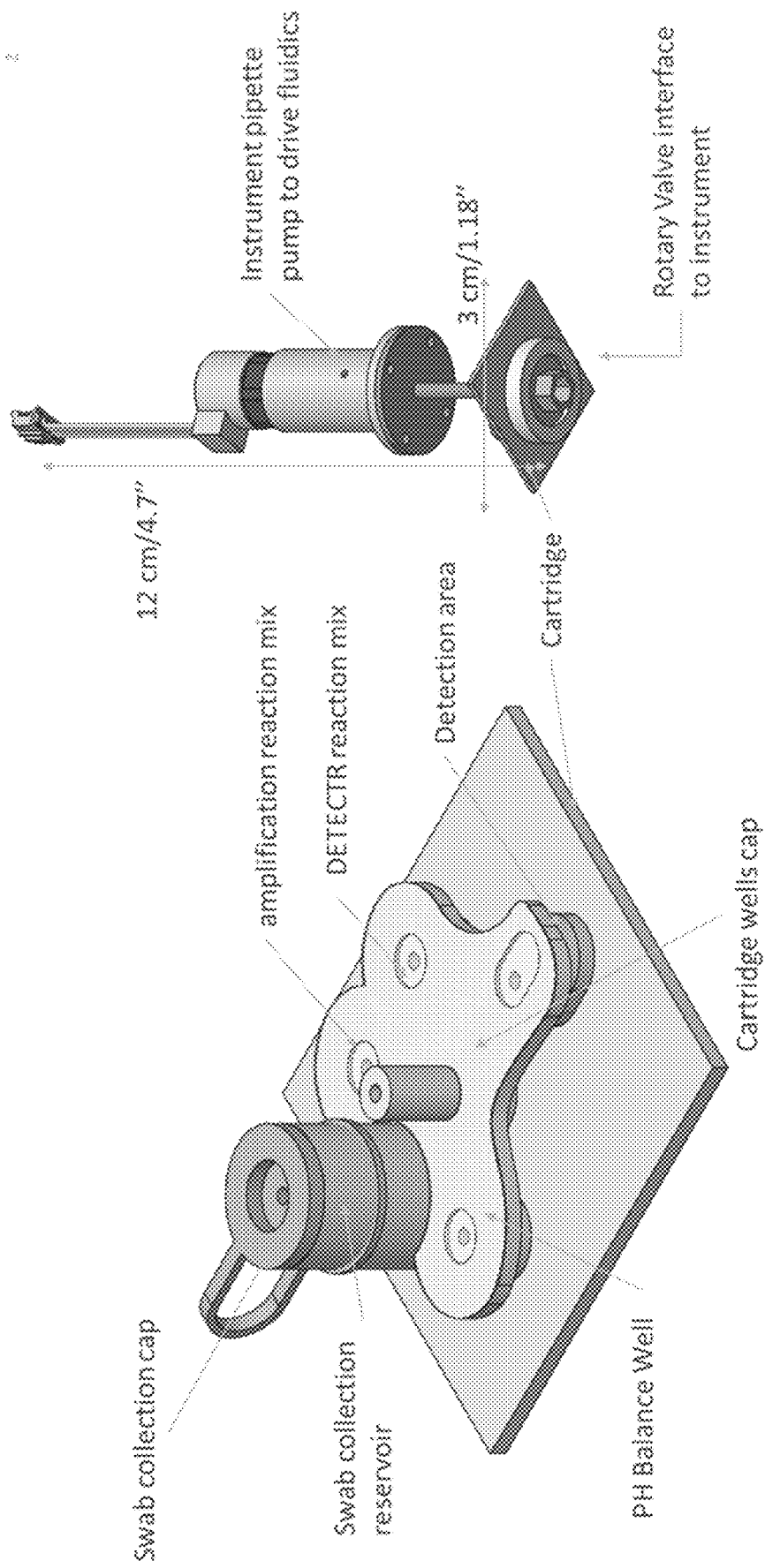

FIG. 84 shows one layout for a DETECTR assay. In this layout a swab collection cap seals a swab reservoir chamber. Clockwise to the swab reservoir chamber is a chamber holding the amplification reaction mix. Clockwise to the chamber holding the amplification reaction mix is a chamber holding the DETECTR reaction mix. Clockwise to this is the detection area. Clockwise to the detection area is the pH balance well. A cartridge wells cap is shown and seals all the wells containing the various reagent mixtures. The cartridge itself is shown as a square layer at the bottom of the schematic. To the right is a diagram of the instrument pipers pump which drives the fluidics in each chamber/well and is connected to the entire cartridge. Below the cartridge is a rotary valve that interfaces with the instrument.

Figure 85:
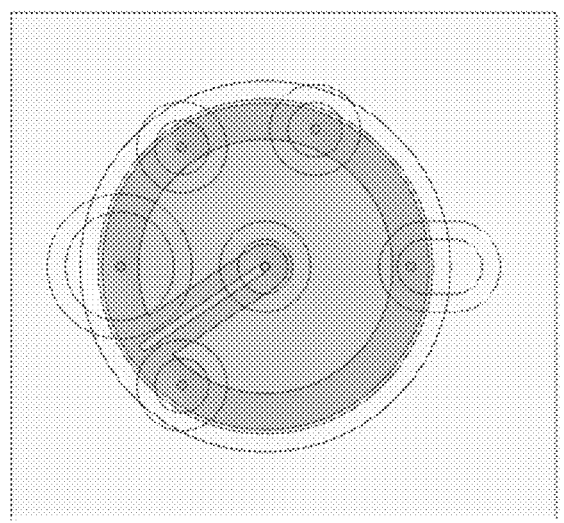
Figure 85:
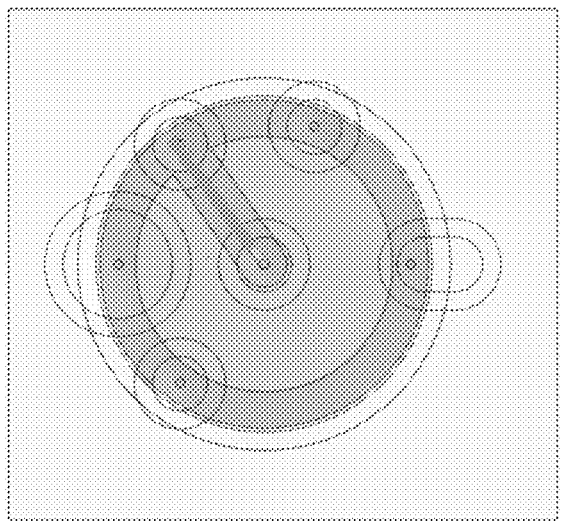
Figure 85:
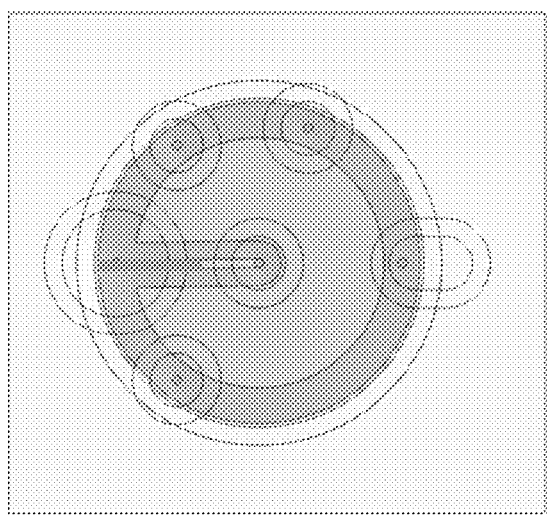
Figure 85:
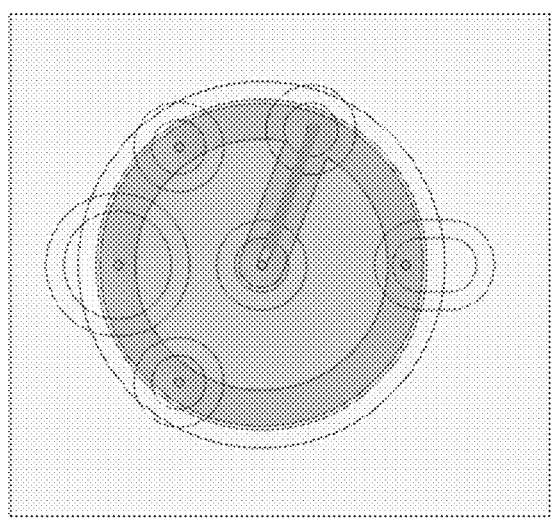
Figure 85:
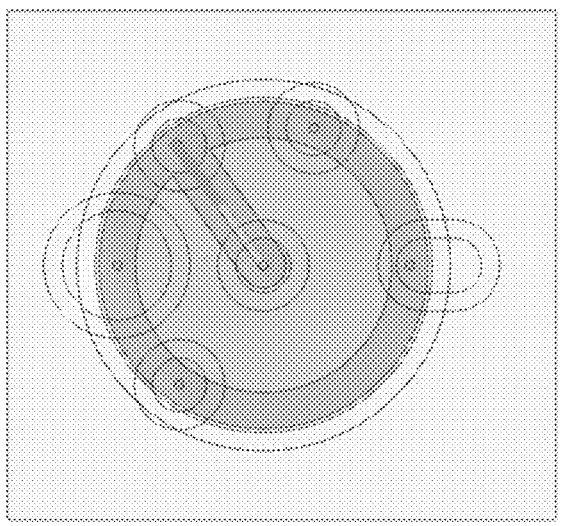
Figure 85:
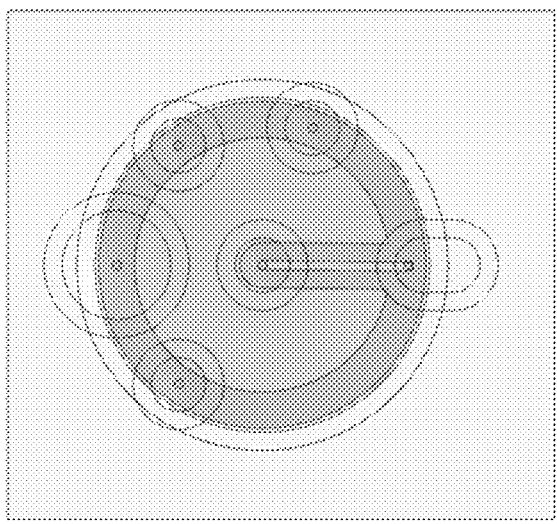

FIG. 85 shows one workflow of the various reactions in the DETECTR assay of FIG. 84. First, as shown in the top left diagram, a swab may be inserted into the 200 ul swab chamber and mixed. In the middle left diagram, the valve is rotated clockwise to the "swab chamber position" and 1 uL of sample is picked up. In the lower left diagram, the valve is rotated clockwise to the "amplification reaction mix" position and the 1 ul of sample is dispensed and mixed. In the top right diagram, 2 uL of sample is aspirated from the "amplification reaction mix". In the top middle diagram, the valve is rotated clockwise to the "DETECTR" position, the sample is dispensed and mixed, and 20 ul of the sample is aspirated. Finally, in the bottom right diagram, the valve is rotated clockwise to the detection area position and 20 ul of the sample is dispensed.

Figure 86:
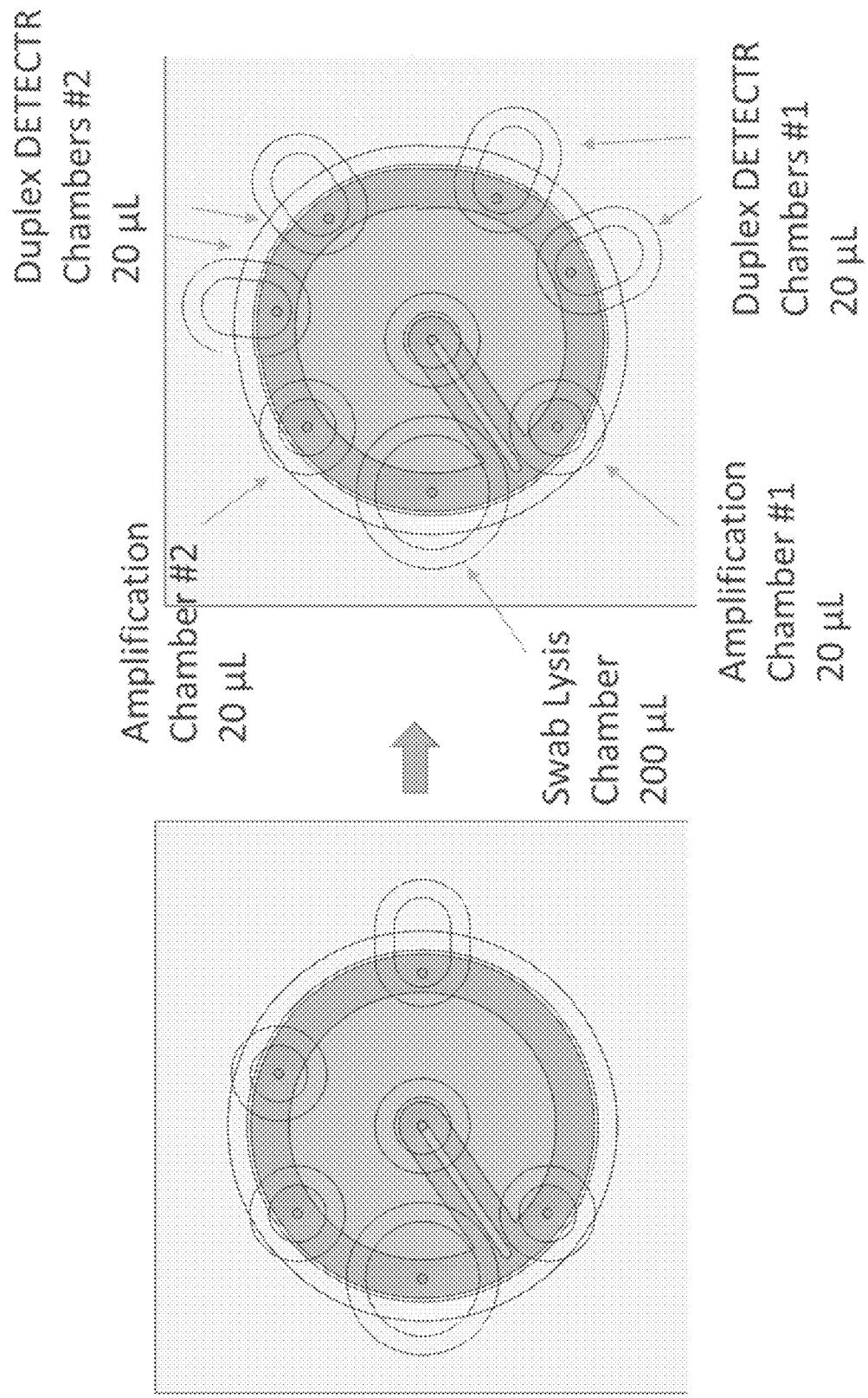

FIG. 86 shows a modification of the workflow shown in FIG. 85 that is also consistent with the methods and systems of the present disclosure. At left is the diagram shown at the top right of FIG. 85. At right is the modified diagram in which there is a first amplification chamber counterclockwise to the swab lysis chamber and a second amplification chamber clockwise to the swab lysis chamber. Additionally, clockwise to amplification chamber #2 are two sets, or "duplex", DETECTR chambers labeled "Duplex DETECTR Chambers #2" and "Duplex DETECTR Chambers #1", respectively.

Figure 87:
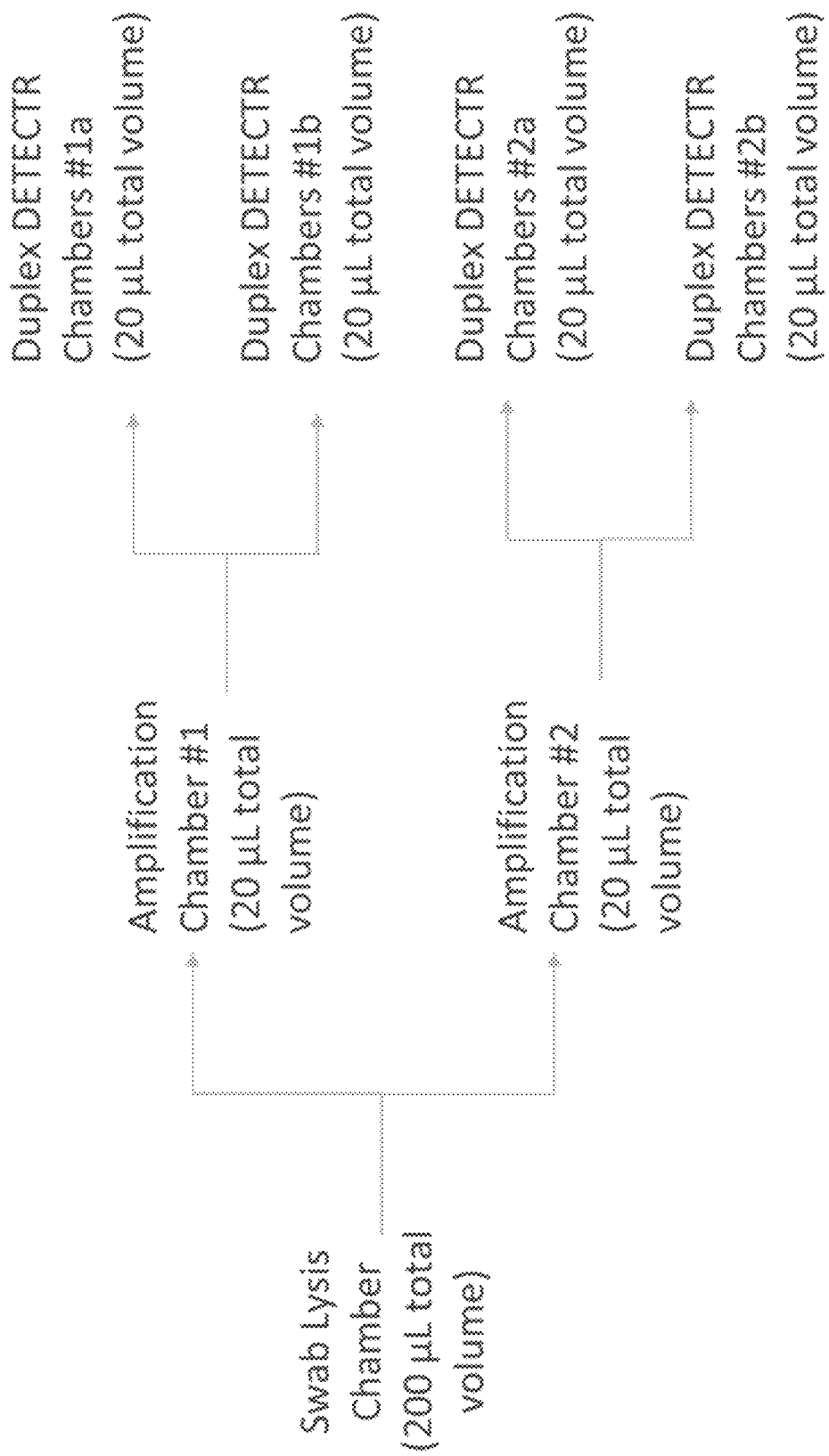

FIG. 87 shows breakdown of the workflow for the modified layout shown in FIG. 86. Specifically, from the swab lysis chamber, which holds 200 ul of sample, 20 ul of the sample can be moved to amplification chamber #1 and 20 ul of the sample can be moved to amplification chamber #2. After amplification in amplification chamber #1, 20 ul of the sample can be moved to Duplex DETECTR Chambers #1a and 20 ul of the sample can be moved to Duplex DETECTR Chambers #1b. Additionally, after amplification in amplification chamber #2, 20 ul of the sample can be moved to Duplex DETECTR Chambers #2a and 20 ul of the sample can be moved to Duplex DETECTR Chambers #2b.

Figure 88:
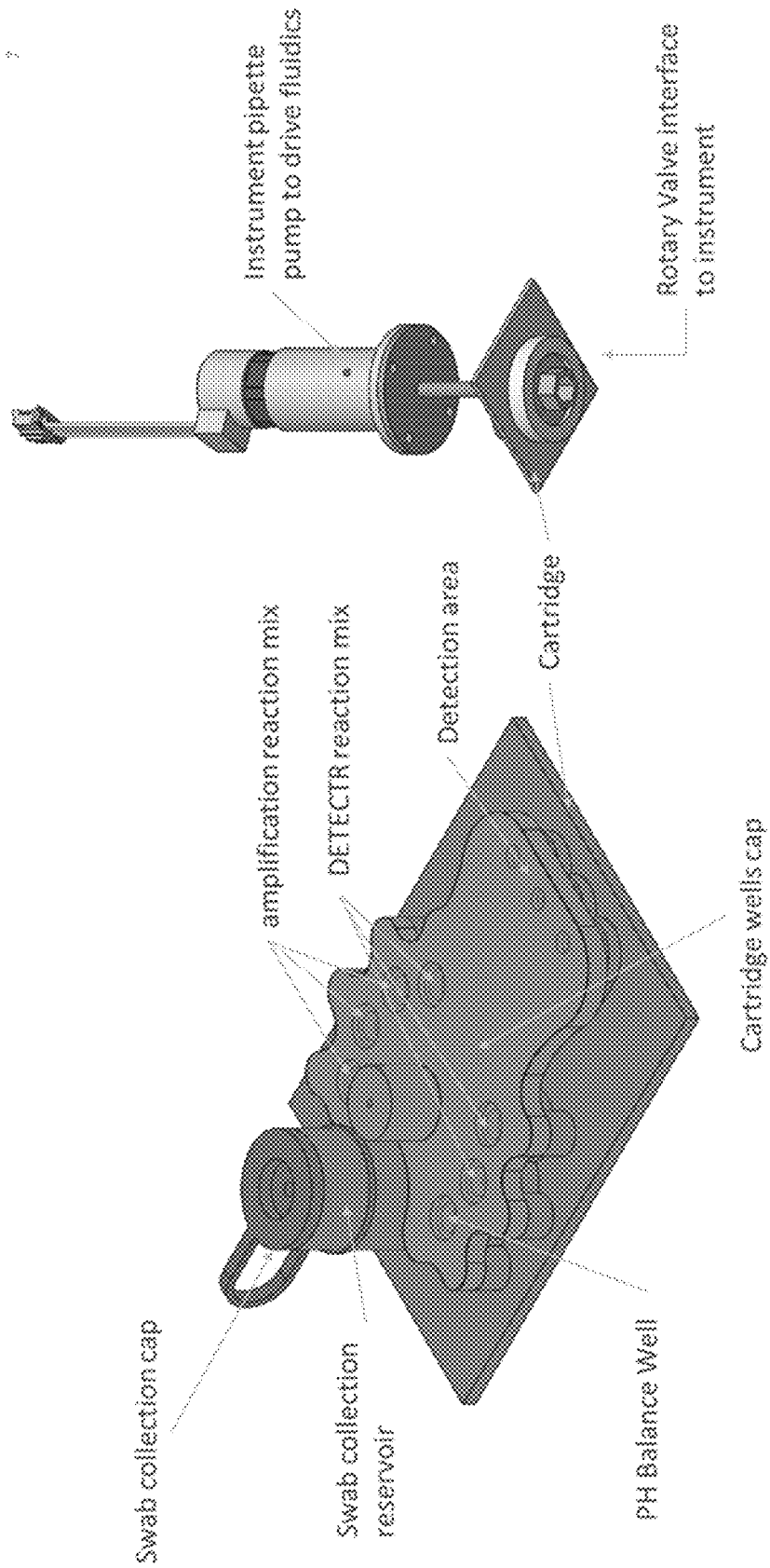

FIG. 88 shows the modifications to the cartridge illustrated in FIG. 86 and FIG. 87.

Figure 89:
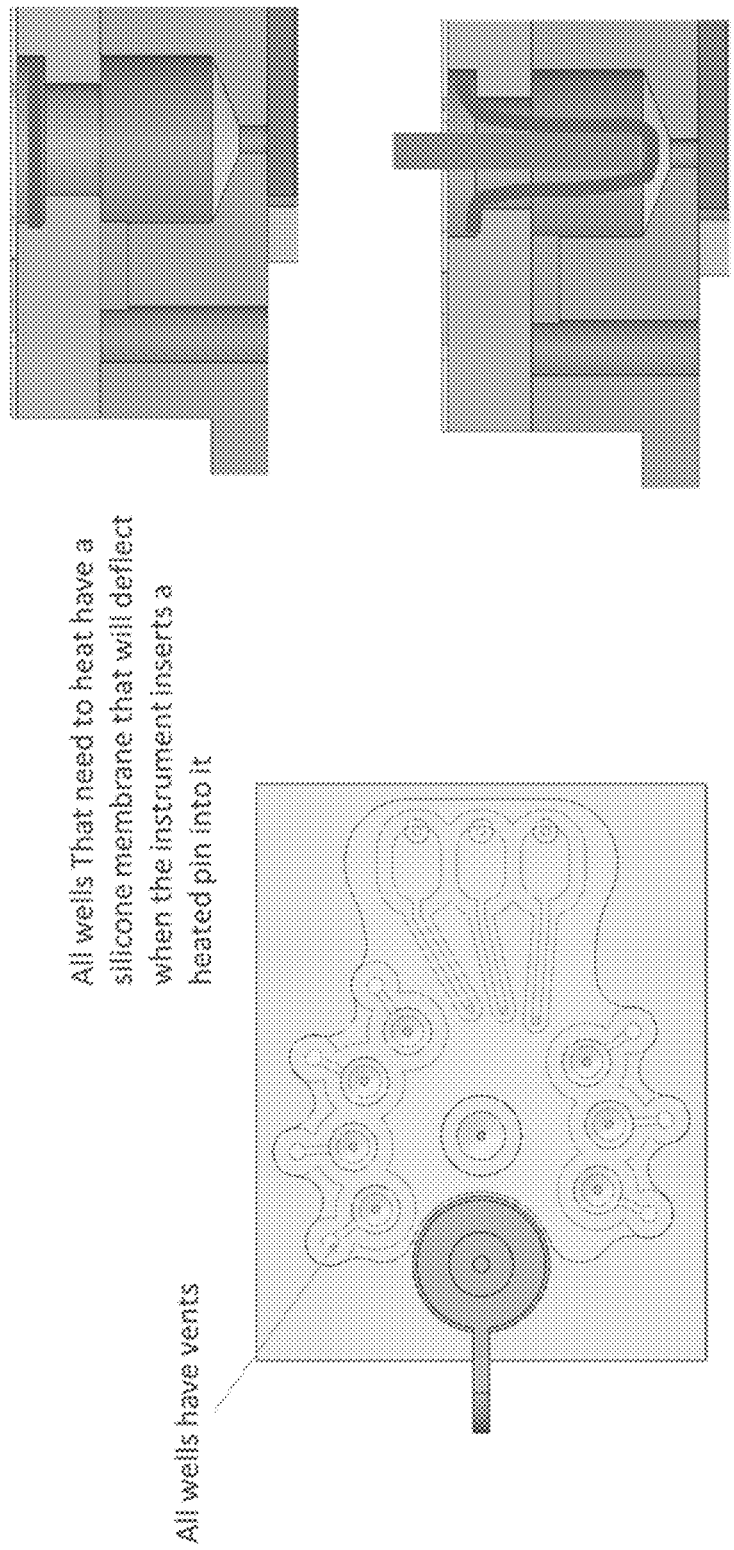

FIG. 89 shows a top down view of the cartridge of FIG. 88. This layout and workflow has a replicate in comparison to the layout and workflow of FIGS. 84-85.

Figure 90:
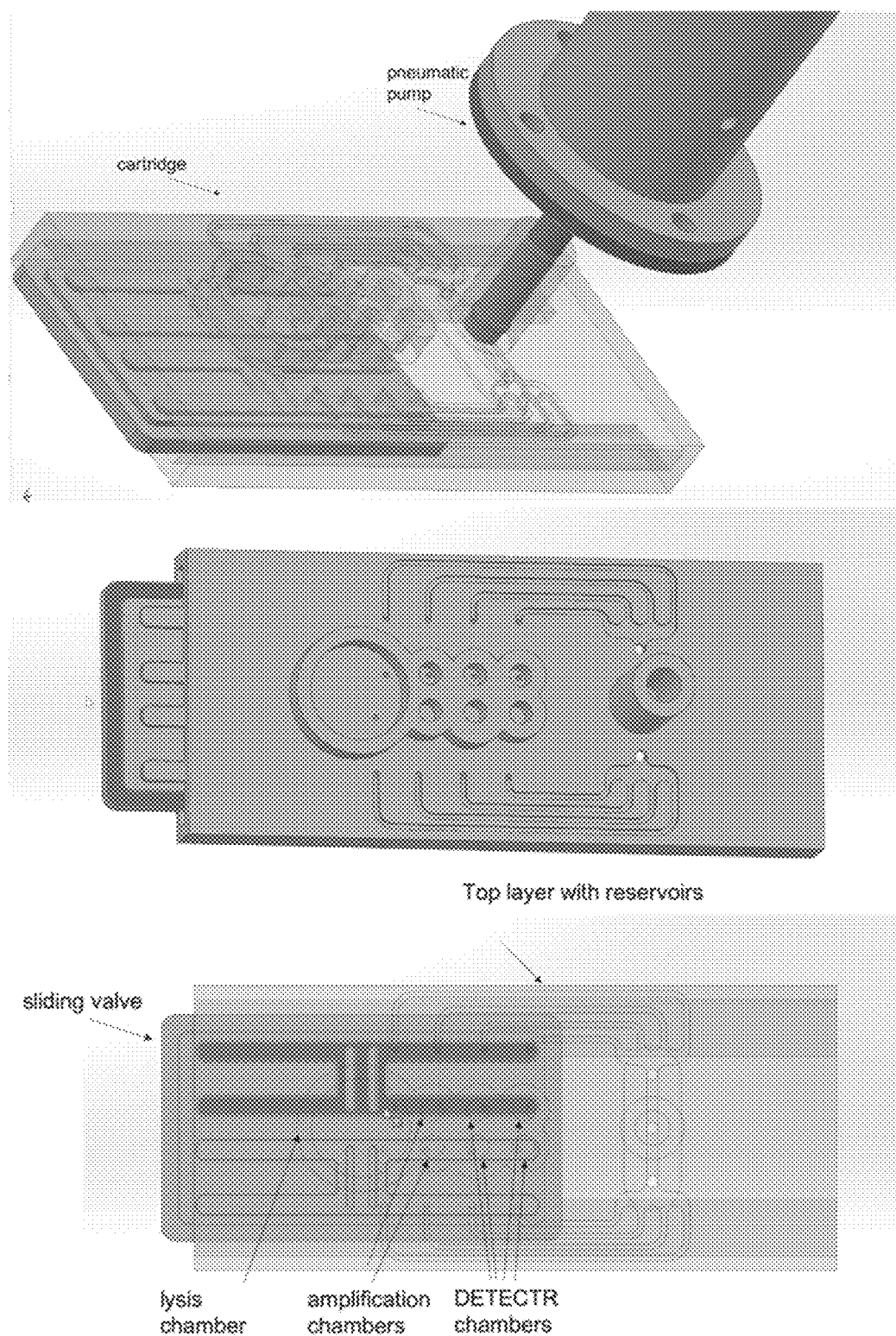

FIG. 90 shows a layout for a DETECTR assay. Shown at top is a pneumatic pump, which interfaces with the cartridge. Shown at middle is a top down view of the cartridge showing a top layer with reservoirs. Shown at bottom is a sliding valve containing the sample and arrows pointing to the lysis chamber at left, following by amplification chambers to the right, and DETECT chambers further to the right.

Figure 91:
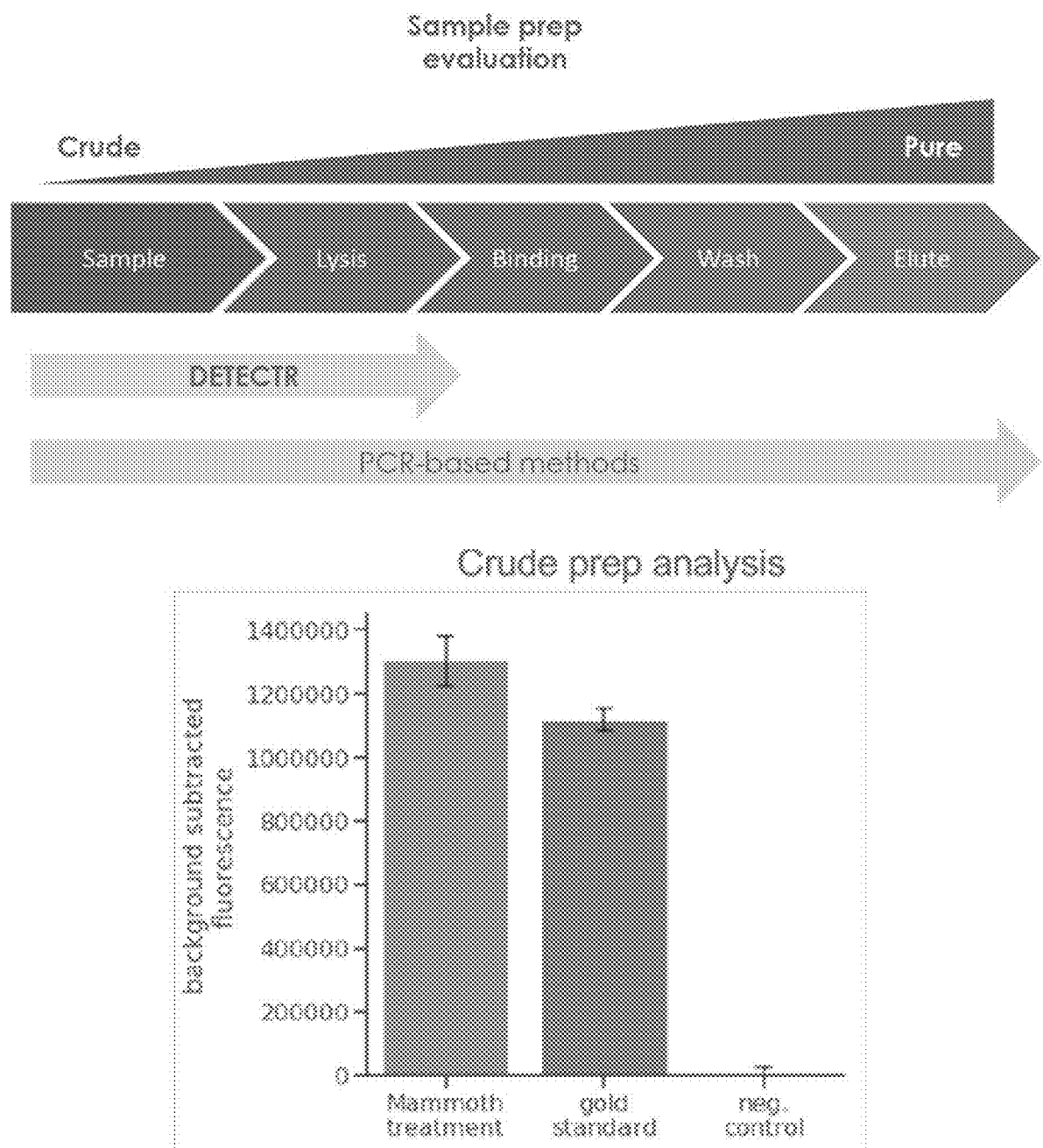

FIG. 91 shows a comparison of the DETECTR assays disclosed herein to the gold standard PCR-based method of detecting a target nucleic acid. Shown at top is a flow chart showing a gradient of sample prep evaluation from crude (left) to pure (right). Sample prep steps that take a crude sample to a pure sample include lysis, binding, washing, and eluting. DETECTR assays disclosed herein may only need the sample prep step of lysis, yielding a crude sample. On the other hand, PCR-based methods can require lysis, binding, washing, and elution, yielding a very pure sample. The graph at bottom shows that even with a cruder sample prep, the DETECTR assay disclosed herein can identify target nucleic acids just as well as gold standard PCR-based methods of detection.

FIG. 92 shows Cas13a detection of RT-LAMP DNA amplicon.

FIG. 92A shows a schematic of the workflow including providing DNA/RNA, LAMP/RT-LAMP, and Cas13a detection.

FIG. 92B shows Cas13a specific detection of RT-LAMP DNA amplicon with a first primer set as measured by background subtracted fluorescence on the y-axis.

FIG. 92C shows Cas13a specific detection of RT-LAMP DNA amplicon with a second primer set as measured by background subtracted fluorescence on the y-axis.

Figure 93:
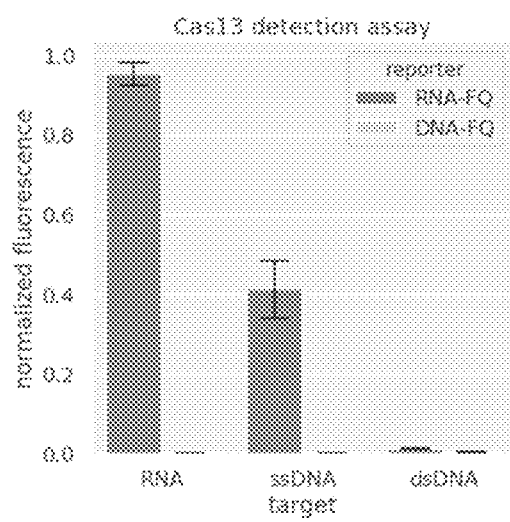
Figure 93:
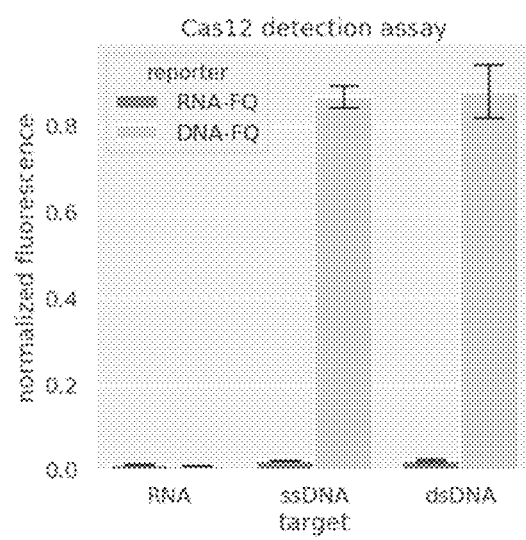
Figure 93:
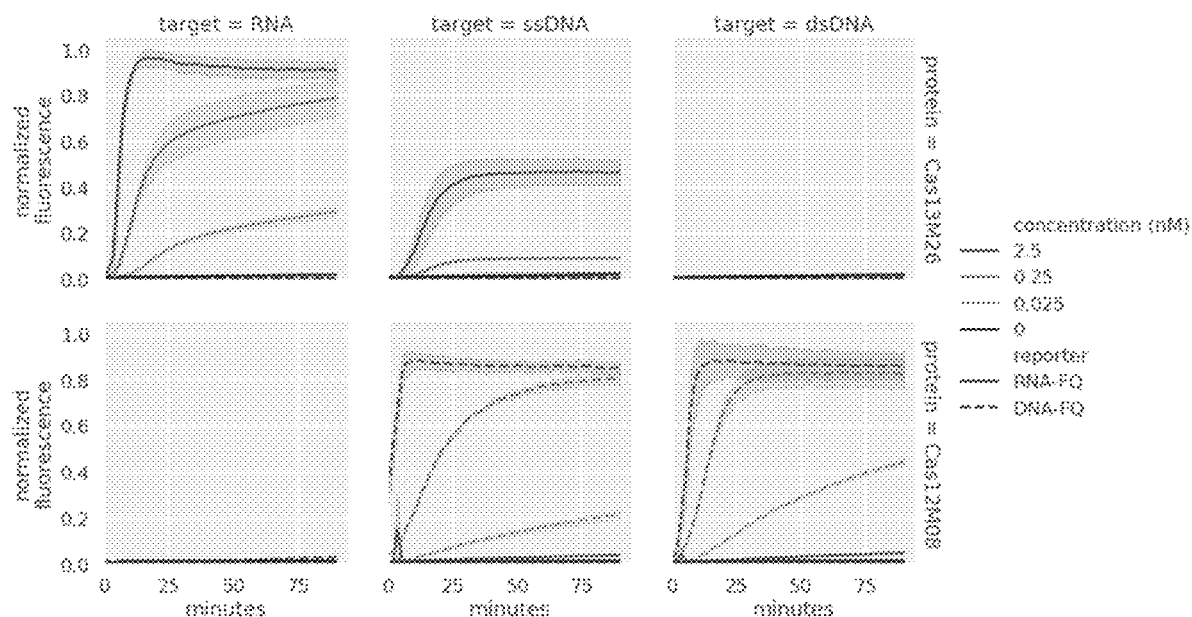

FIG. 93A shows a Cas13 detection assay using 2.5 nM RNA, single-stranded DNA (ssDNA), or double-stranded (dsDNA) as target nucleic acids, where detection was measured by fluorescence for each of the targets tested.

FIG. 93B shows Cas12 detection assay using 2.5 nM RNA, ssDNA, and dsDNA as target nucleic acids, where detection was measured by fluorescence for each of the targets tested.

FIG. 93C shows the performance of Cas13 and Cas12 on RNA, ssDNA, and dsDNA targets at various concentrations, where detection was measured by fluorescence for each of the targets tested.

Figure 94:
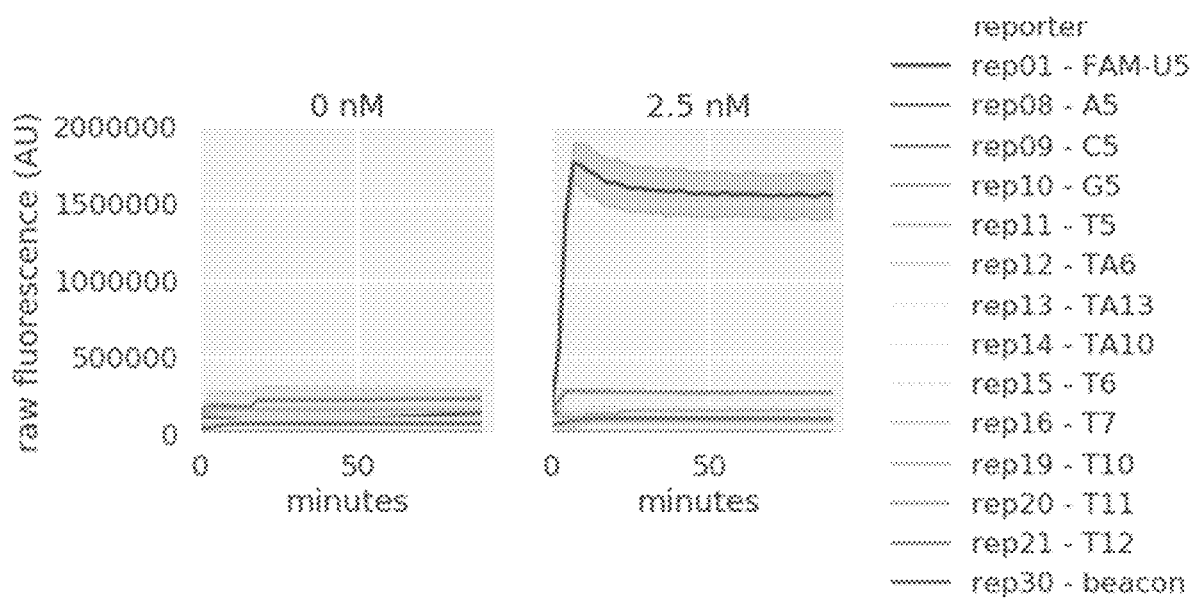

FIG. 94 shows an Lbu-Cas13a detection assay using 2.5 nM ssDNA target with 170 nM of various reporter substrates, wherein detection was measured by fluorescence for each of the reporter substrates tested.

FIG. 95A shows the results of Cas13 detection assays for Lbu-Cas13a and Lwa-Cas13a using 10 nM or 0 nM of RNA target, where detection was measured by fluorescence resulting from cleavage of reporters over time.

FIG. 95B shows the results of Cas13 detection assays for Lbu-Cas13a and Lwa-Cas13a using 10 nM or 0 nM of ssDNA target, where detection was measured by fluorescence resulting from cleavage of reporters over time.

Figure 96:
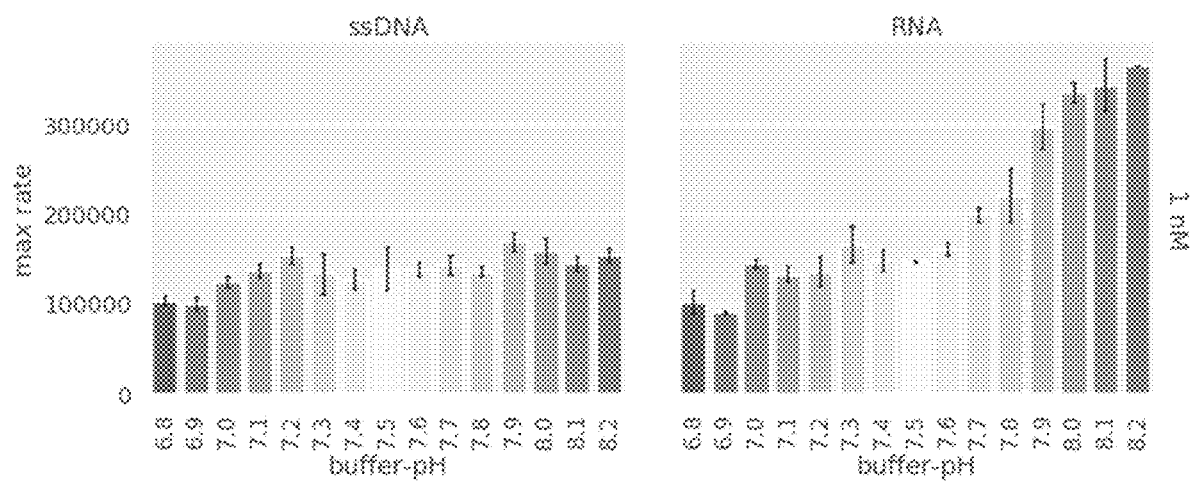

FIG. 96 shows Lbu-Cas13a detection assay using 1 nM RNA (at left) or ssDNA (at right) target in buffers with various pH values ranging from 6.8 to 8.2.

FIG. 97A shows guide RNAs (gRNAs) tiled along a target sequence at 1 nucleotide intervals.

FIG. 97B shows Cas13M26 detection assays using 0.1 nM RNA or 2 nM ssDNA target with gRNAs tiled at 1 nucleotide intervals and an off-target gRNA.

FIG. 97C shows data from FIG. 97B ranked by performance of ssDNA.

FIG. 97D shows performance of gRNAs on RNA split by the identity of the nucleotide on the target that is 3' of the target sequence.

FIG. 97E shows performance of gRNAs on RNA split by the identity of the nucleotide on the target that is 3' of the target sequence.

FIG. 98A shows Lbu-Cas13a detection assays using 1 µL of DNA amplicon from various LAMP isothermal nucleic acid amplification reactions.

FIG. 98B shows Cas13M26 detection assays using various amounts of PCR reaction as a DNA target.

Figure 99:
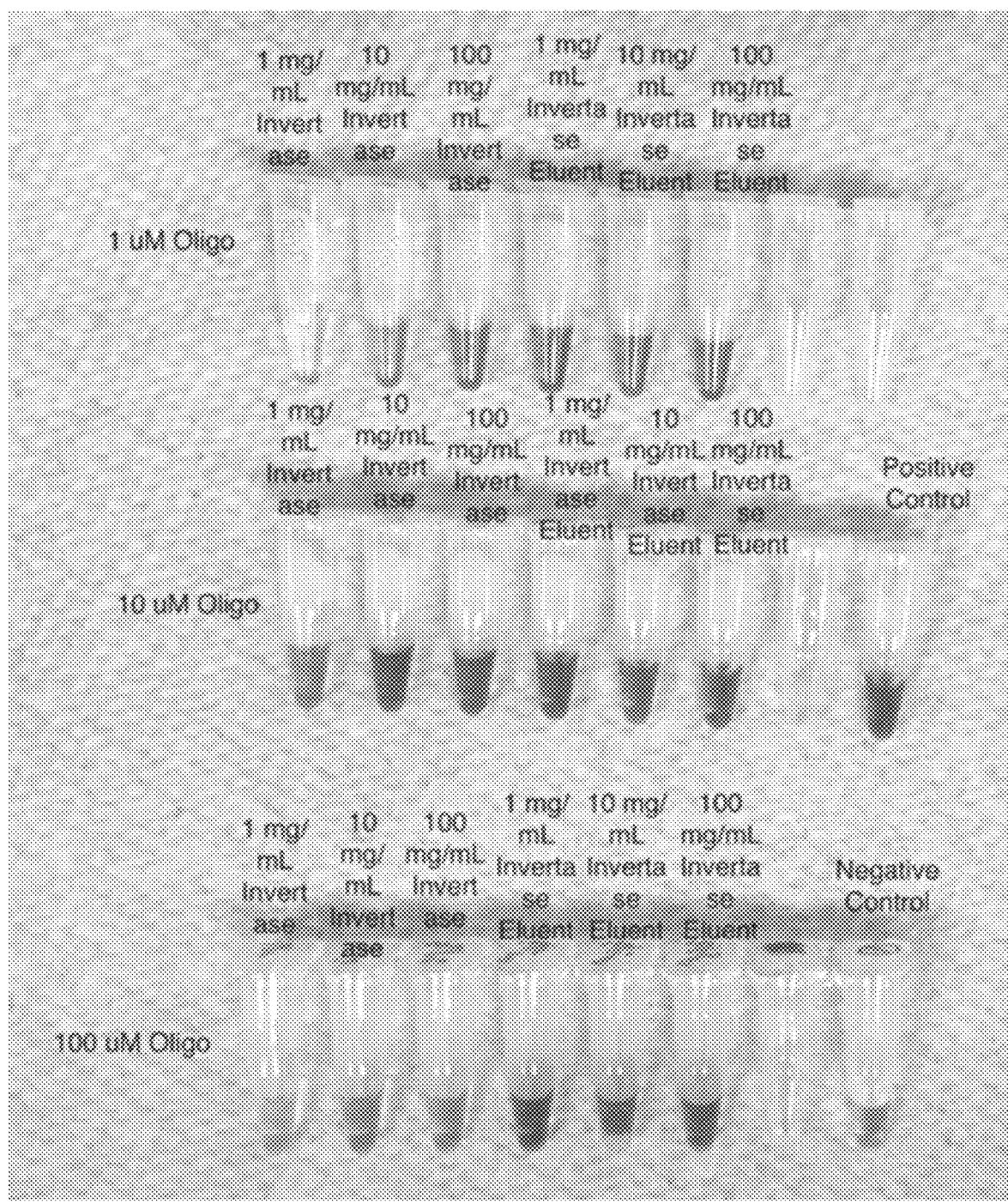

FIG. 99 illustrates a DNS sucrose reaction with invertase-conjugated DNA oligos.

FIG. 100 shows a pneumatic valve device layout for a DETECTR assay.

FIG. 100A shows a schematic of a pneumatic valve device. A pipette pump aspirates and dispenses samples. An air manifold is connected to a pneumatic pump to open and close the normally closed valve. The pneumatic device moves fluid from one position to the next. The pneumatic design has reduced channel cross talk compared to other device designs.

FIG. 100B shows a schematic of a cartridge for use in the pneumatic valve device shown in FIG. 100A. The valve configuration is shown. The normally closed valves (one such valve is indicated by an arrow) comprise an elastomeric seal on top of the channel to isolate each chamber from the rest of the system when the chamber is not in use. The pneumatic pump uses air to open and close the valve as needed to move fluid to the necessary chambers within the cartridge.

Figure 101:
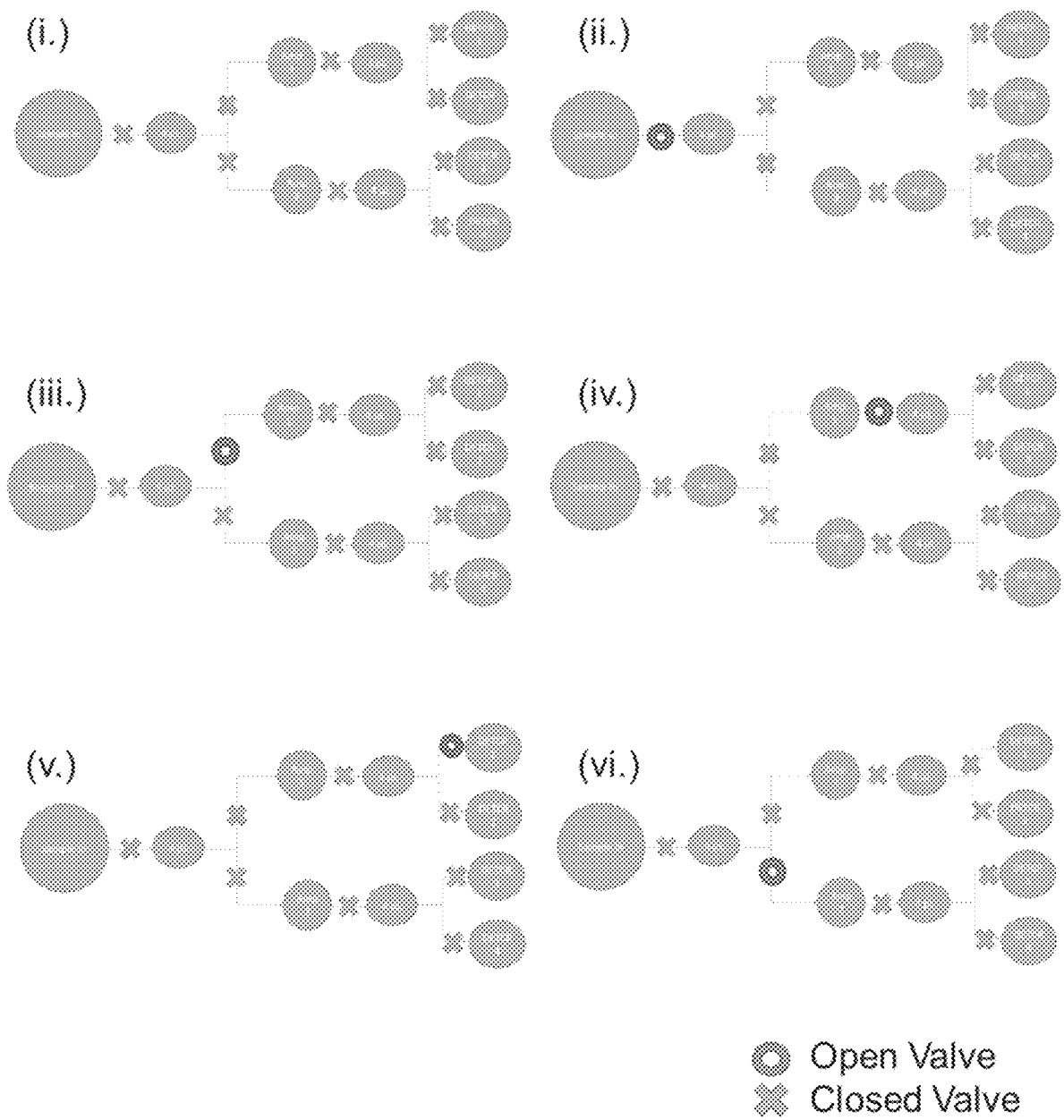

FIG. 101 shows a valve circuitry layout for the pneumatic valve device shown in FIG. 100A. A sample is placed in the sample well while all valves are closed, as shown at (i.). The sample is lysed in the sample well. The lysed sample is moved from the sample chamber to a second chamber by opening the first quake valve, as shown at (ii.), and aspirating the sample using the pipette pump. The sample is then moved to the first amplification chamber by closing the first quake valve and opening a second quake valve, as shown at (iii.) where it is mixed with the amplification mixture. After the sample is mixed with the amplification mixture, it is moved to a subsequent chamber by closing the second quake valve and opening a third quake valve, as shown at (iv). The sample is moved to the DETECTR chamber by closing the third quake valve and opening a fourth quake valve, as shown at (v). The sample can be moved through a different series of chambers by opening and closing a different series of quake valves, as shown at (vi). Actuation of individual valves in the desired chamber series prevents cross contamination between channels.

Figure 102:
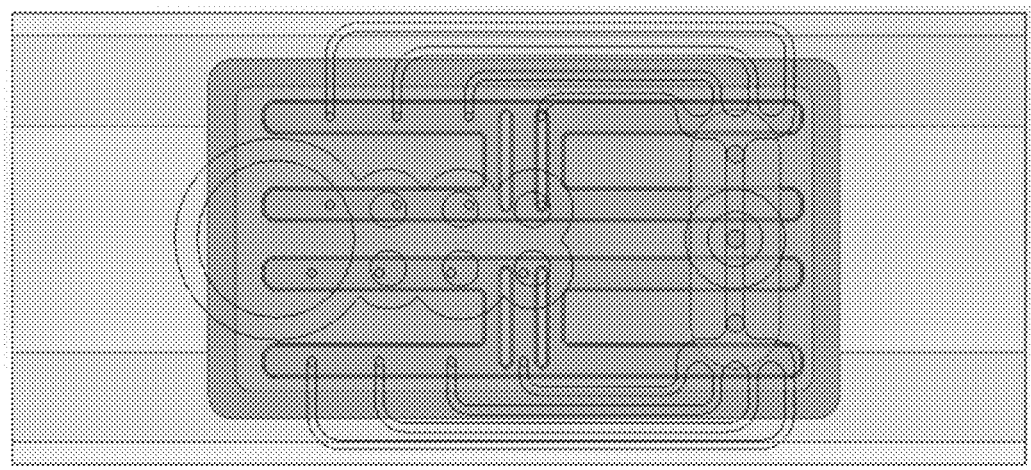

FIG. 102 shows a schematic of a sliding valve device. The offset pitch of the channels allows aspirating and dispensing into each well separately and helps to mitigate cross talk between the amplification chambers and corresponding chambers.

Figure 103:
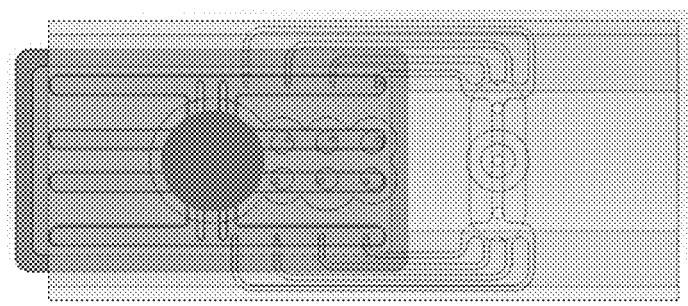
Figure 103:
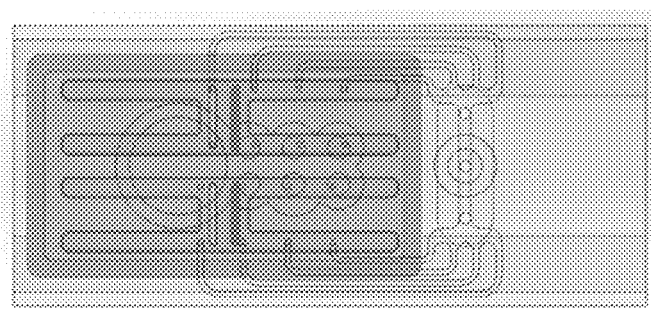
Figure 103:
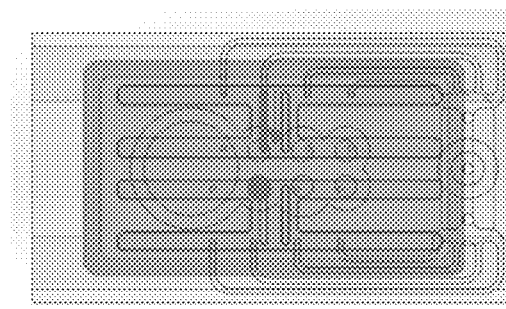
Figure 103:
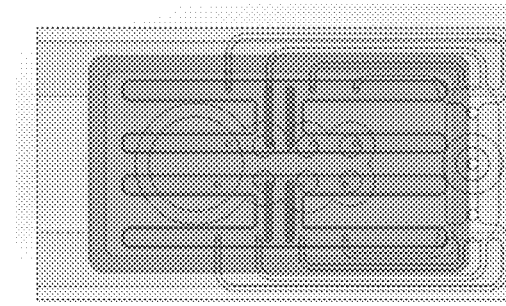
Figure 103:
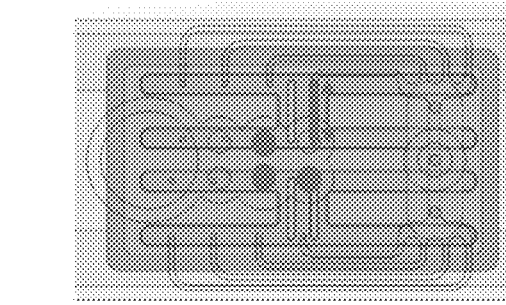

FIG. 103 shows a diagram of sample movement through the sliding valve device shown in FIG. 102. In the initial closed position (i.), the sample is loaded into the sample well and lysed. The sliding valve is then actuated by the instrument, and samples are loaded into each of the channels using the pipette pump, which dispenses the appropriate volume into the channel (ii.). The sample is delivered to the amplification chambers by actuating the sliding valve and mixed with the pipette pump (iii.). Samples from the amplification chamber are aspirated into each channel (iv.) and then dispensed and mixed into each DETECTR chamber (v.) by actuating the sliding valve and pipette pump.

Figure 104:
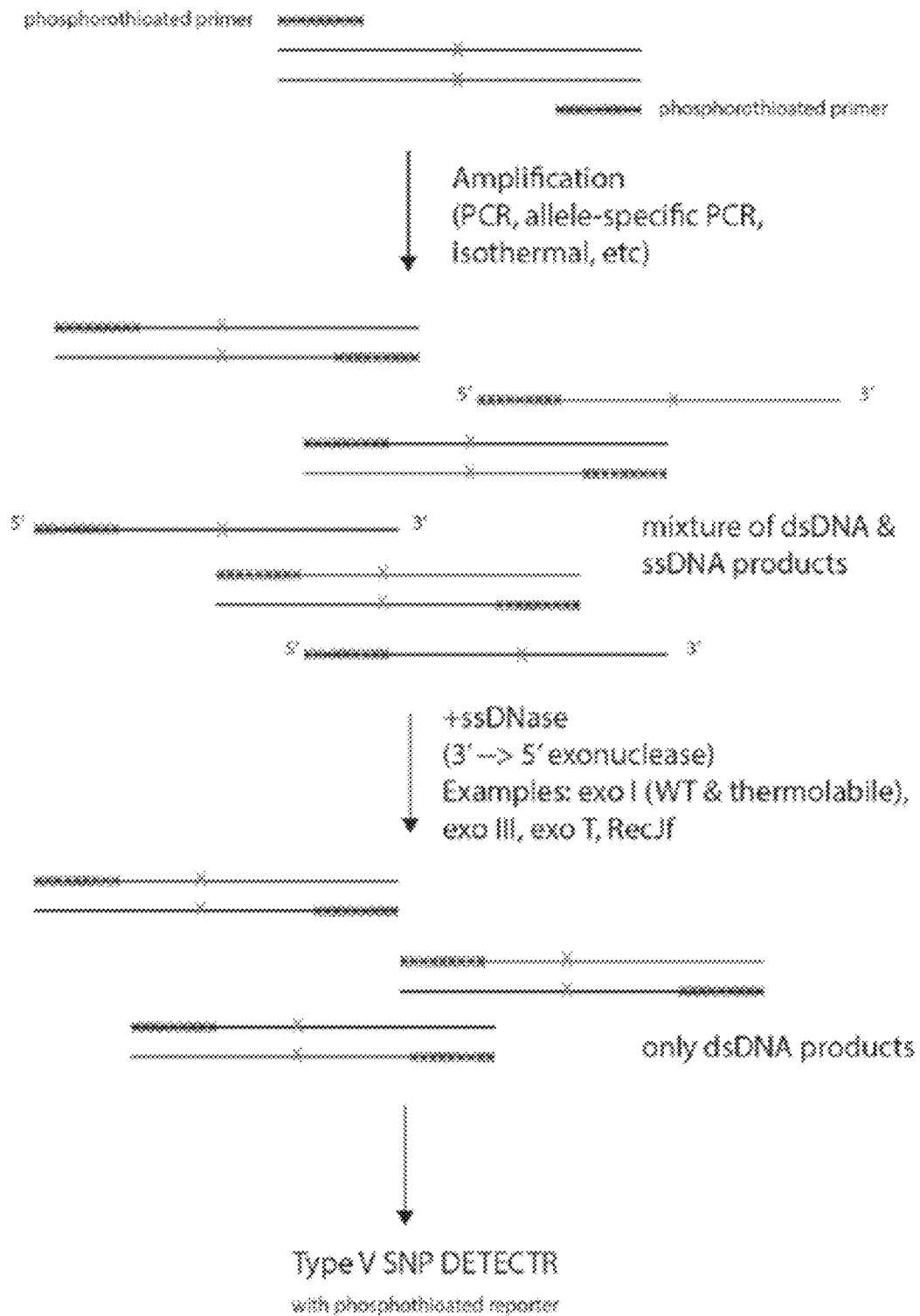

FIG. 104 illustrates a method of removing ssDNA from a type V programmable nuclease DETECTR reaction following target amplification. A target nucleic acid is amplified using PCR, allele-specific PCR, or isothermal amplification. The amplification process results in a mixture of dsDNA and ssDNA products. A ssDNase 3' to 5' exonuclease I, exonuclease III, exonuclease T, or RecJf is added to the amplified target nucleic acid sample. The ssDNase degrades ssDNA, leaving only dsDNA products. The presence of a SNP of interest in the target dsDNA is then detected using a type V SNP DETECTR reaction.

Figure 105:
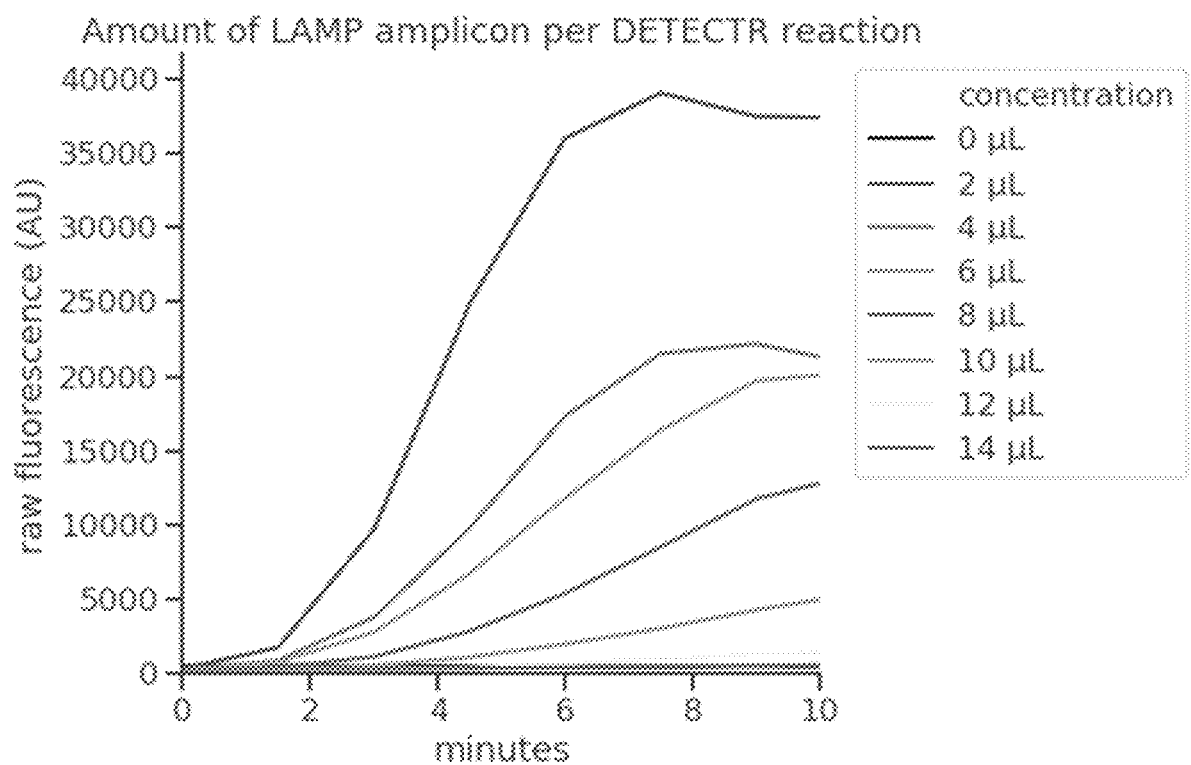

FIG. 105 shows the raw fluorescence produced in each well containing a Cas12a complexing reaction with different volumes of LAMP amplicon product. A higher fluorescence value is indicative of better assay performance. Addition of 2 µL of LAMP amplicon per DETECTR reaction showed the best assay performance (highest fluorescence) of any of the conditions tested. Increasing volumes of LAMP amplicon resulted in a decreasing assay performance, as measured by fluorescence.

Figure 106:
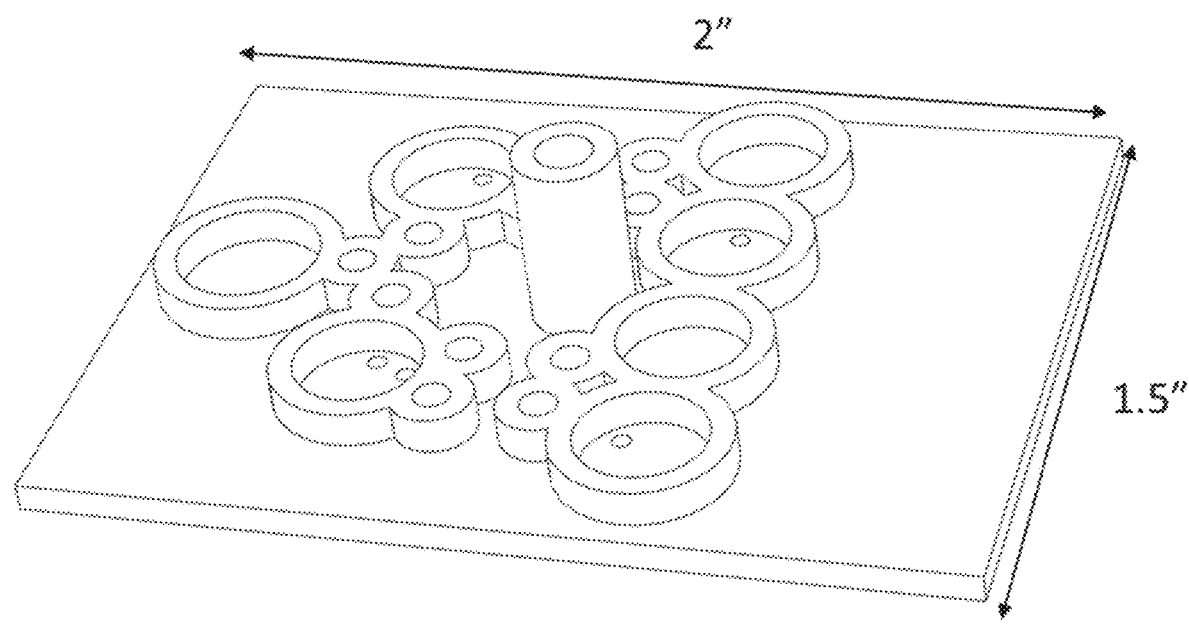

FIG. 106 shows a schematic of the top layer of a cartridge of a pneumatic valve device of the present disclosure, highlighting suitable dimensions. The schematic shows one cartridge that is 2 inches by 1.5 inches.

Figure 107:
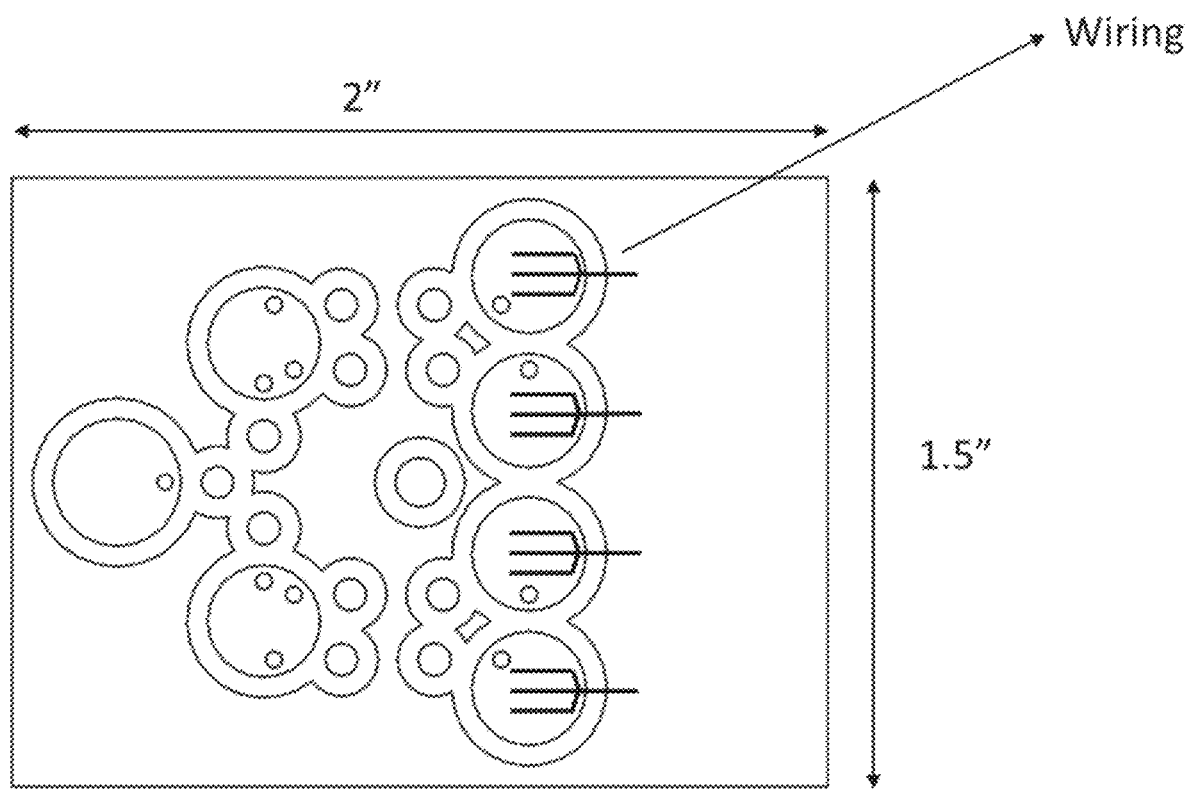

FIG. 107 shows a schematic of a modified top layer of a cartridge of a pneumatic valve device of the present disclosure adapted for electrochemical dimension. In this schematic, three lines are shown in the detection chambers (4 chambers at the very right). These three lines represent wiring (or "metal leads"), which is co-molded, 3D-printed, or manually assembled in the disposable cartridge to form a three-electrode system.

DETAILED DESCRIPTION

Described herein are devices, systems, fluidic devices, kits, and methods for detecting the presence of a target nucleic acid in a sample. The devices, systems, fluidic devices, kits, and methods for detecting the presence of a target nucleic acid in a sample can be used in a rapid test (e.g., lab test or point-of-care test) for detection of a target nucleic acid of interest. For example, disclosed herein are particular microfluidic devices, lateral flow devices, sample preparation devices, and compositions (e.g., programmable nucleases, guide RNAs, reagents for in vitro transcription, reagents for amplification, reagents for reverse transcription, reporters, or any combination thereof) for use in said devices that are particularly well suited for carrying out a highly efficient, rapid, and accurate reactions for detecting whether a target nucleic acid is present in a sample. In particular, provided herein are devices, systems, fluidic devices, and kits, wherein the rapid tests can be performed in a single system. The target nucleic acid may be a portion of a nucleic acid of interest, e.g., a target nucleic acid from any plant, animal, virus, or microbe of interest.

A device, system, fluidic device, or kit for rapid tests, as described herein, may comprise reagents for the detection of a target nucleic acid using a programmable nuclease. The device, system, fluidic device, or kit for rapid tests may enable monitoring and visualization of a target nucleic acid in a sample. For example, reagents disclosed herein (e.g., programmable nucleases, guide RNAs, reagents for in vitro transcription, reagents for amplification, reagents for reverse transcription, and reporters, or any combination thereof) are particularly well suited for use in a device described herein to carry out highly efficient, rapid, and accurate reactions for detecting whether a target nucleic acid is present in a sample. A device described herein may include a particular microfluidic device (e.g., a pneumatic valve device, a sliding valve device, or a rotating valve device), a lateral flow device, or a sample preparation device. In some embodiments, the method for use of the device, system, fluidic device, or kit for rapid tests may comprise some or all of the steps of sample preparation, nucleic acid amplification, programmable nuclease reaction incubation, and detection or readout.

Various ailments, such as communicable disease, cancer, and genetic disorders, may have poor outcomes, including severe symptoms that can lead to death. The capability to quickly and accurately detect the presence of an ailment can provide valuable information and lead to actions to reduce the progression or transmission of the ailment.

The devices, systems, fluidic devices, kits, and methods for detecting the presence of a target nucleic acid in a sample are advantageous for detecting a target nucleic acid comprising a particular genotype or associated with particular phenotype, such as detection of a target nucleic acid associated with a communicable disease. Various communicable diseases can easily spread from an individual or environment to an individual. Individuals with one or more of these diseases may have poor outcomes, including severe symptoms that can lead to death. The detection of the disease in an individual, especially at the early stages of the disease, may provide guidance on treatments or interventions to reduce the progression of the disease. Additionally, the detection of traits of the disease, such as resistance to an antibiotic, can be useful for informing treatment of the disease. The detection of the disease in the environment may provide guidance on interventions to reduce or minimize a potential epidemic or transmission of the disease. The capability to quickly and accurately detect the presence of a disease in a biological or environmental sample can provide valuable information and lead to actions to reduce the transmission of the disease.

Additionally, early detection of cancers and genetic disorders can be important for initiating treatment. Individuals with cancer or genetic disorders may have poor outcomes, including severe symptoms that can lead to death, if left undetected. The detection of the cancer or genetic disorder in an individual, especially at the early stages of the cancer or genetic disorder, may provide guidance on treatments or interventions to reduce the progression of the cancer or maladies associated with progression of the genetic disorder.

The present disclosure provides various devices, systems, fluidic devices, and kits for rapid tests, which may quickly assess whether a target nucleic acid is present in a sample by using a programmable nuclease that can interact with functionalized surfaces of the fluidic systems to generate a detectable signal. For example, disclosed herein are particular microfluidic devices, lateral flow devices, sample preparation devices, and compositions (e.g., programmable nucleases, guide RNAs, reagents for in vitro transcription, amplification, reverse transcription, and reporters, or any combination thereof) for use in said devices that are particularly well suited to carry out a highly efficient, rapid, and accurate reactions for detecting the presence of a target nucleic acid (e.g., a DETECTR reaction). The systems and programmable nucleases disclosed herein can be used as a companion diagnostic with any of the diseases disclosed herein (e.g., RSV, sepsis, flu), or can be used in reagent kits, point-of-care diagnostics, or over-the-counter diagnostics. The systems may be used as a point of care diagnostic or as a lab test for detection of a target nucleic acid and, thereby, detection of a condition, for example, in a subject from which the sample was taken. The systems may be used in various sites or locations, such as in laboratories, in hospitals, in physician offices/laboratories (POLs), in clinics, at remotes sites, or at home. Sometimes, the present disclosure provides various devices, systems, fluidic devices, and kits for consumer genetic use or for over the counter use.

Furthermore, detection of a target nucleic acid for determining genetic information is consistent with the methods devices, systems, fluidic devices, kits, and methods described herein. A target nucleic acid for determining genetic information can include, but is not limited to, a nucleic acid associated with organism ancestry (e.g., a nucleic acid comprising a single nucleotide polymorphism that identifies geographical ancestry, ancestry from an ethnic group, etc.); a nucleic acid for trait not associated with a communicable disease, cancer, or genetic disorder; a nucleic acid for a phenotypic trait (e.g., a nucleic acid from a gene for blue eyes, brown hair color, fast or slow metabolism of a drug such as caffeine, an intolerance such as lactose intolerance, etc.), or a nucleic acid for genotyping (e.g., a nucleic acid for a gene that is recessive, such as the gene for Taye-Sachs disease).

Described herein are devices, systems, fluidic devices, kits, and methods for detecting the presence of a target nucleic acid in a sample. The devices, systems, fluidic devices, kits, and methods for detecting the presence of a target nucleic acid in a sample can be used in a rapid test (e.g., lab test or point-of-care test) for detection of a target nucleic acid of interest. For example, disclosed herein are particular microfluidic devices, lateral flow devices, sample preparation devices, and compositions (e.g., programmable nucleases, guide RNAs, reagents for in vitro transcription, reagents for amplification, reagents for reverse transcription, reporters, or any combination thereof) for use in said devices that are particularly well suited to carrying out a highly efficient, rapid, and accurate for detecting whether a target nucleic acid is present in a sample (e.g., a DETECTR reaction). In particular, provided herein are devices, systems, fluidic devices, and kits, wherein the rapid tests can be performed in a single system. The target nucleic acid may be a portion of a nucleic acid from a virus or a *bacterium* or other agents responsible for a disease in the sample. The target nucleic acid may be a portion of a nucleic acid from a gene expressed in a cancer or genetic disorder in the sample. The target nucleic acid may be a portion of an RNA or DNA from any organism in the sample. In some embodiments, programmable nucleases disclosed herein are activated to initiate trans cleavage activity of an RNA reporter by RNA or DNA. As used herein, "trans cleavage" is used interchangeably with "collateral cleavage." A programmable nuclease as disclosed herein is, in some cases, binds to a target RNA to initiate trans cleavage of an RNA reporter, and this programmable nuclease can be referred to as an RNA-activated programmable RNA nuclease. In some instances, a programmable nuclease as disclosed herein binds to a target DNA to initiate trans cleavage of an RNA reporter, and this programmable nuclease can be referred to as a DNA-activated programmable RNA nuclease. In some cases, a programmable nuclease as described herein is capable of being activated by a target RNA or a target DNA. For example, a Cas13, such as Cas13a, disclosed herein is activated by a target RNA nucleic acid or a target DNA nucleic acid to transcollaterally cleave RNA reporter molecules. In some embodiments, the Cas13 binds to a target ssDNA which initiates trans cleavage of RNA reporters. In some instances, a programmable nuclease as disclosed herein binds to a target DNA to initiate trans cleavage of a DNA reporter, and this programmable nuclease can be referred to as a DNA-activated programmable DNA nuclease.

The programmable nuclease can become activated after binding of a guide nucleic acid with a target nucleic, in which the activated programmable nuclease can cleave the target nucleic acid and can have trans cleavage activity. Trans cleavage activity can be non-specific cleavage of nearby single-stranded nucleic acids by the activated programmable nuclease, such as trans cleavage of detector nucleic acids with a detection moiety. Once the detector nucleic acid is cleaved by the activated programmable nuclease, the detection moiety can be released or separated from the reporter and generates a detectable signal that is immobilized on a support medium. Often the detection moiety is at least one of a fluorophore, a dye, a polypeptide, or a nucleic acid. Sometimes the detection moiety binds to a capture molecule on the support medium to be immobilized. The detectable signal can be visualized on the support medium to assess the presence or level of the target nucleic acid associated with an ailment, such as a disease, cancer, or genetic disorder. The programmable nuclease can be a CRISPR-Cas (clustered regularly interspaced short palindromic repeats—CRISPR associated) nucleoprotein complex with trans cleavage activity, which can be activated by binding of a guide nucleic acid with a target nucleic acid.

The reporter molecules can be RNA reporter molecules, wherein the RNA reporter molecule comprises at least one ribonucleic acid and a detectable moiety. In some embodiments, the Cas13a recognizes and detects ssDNA and, further, specifically trans-cleaves RNA reporters. The detection of the target nucleic acid in the sample may indicate the presence of the disease in the sample and may provide information for taking action to reduce the transmission of the disease to individuals in the disease-affected environment or near the disease-carrying individual. The detection of the target nucleic acid in the sample may indicate the presence of a disease mutation, such as a single nucleotide polymorphism (SNP) that provides antibiotic resistance to a disease-causing bacteria. The detection of the target nucleic acid in the sample may indicate the presence of the cancer or genetic disorder in the sample and may provide information for treating or slowing progression of the cancer or genetic disorder. The detection of the target nucleic acid is facilitated by a programmable nuclease.

A device, system, fluidic device, or kit for rapid tests, as described herein, may comprise reagents for the detection of a target nucleic acid using a programmable nuclease. The device, system, fluidic device, or kit for rapid tests may enable monitoring and visualization of a target nucleic acid in a sample. For example, reagents disclosed herein (e.g., programmable nucleases, guide RNAs, reagents for in vitro transcription, reagents for amplification, reagents for reverse transcription, and reporters, or any combination thereof) are particularly well suited for use in a device described herein to carry out highly efficient, rapid, and accurate for detecting the presence of a target nucleic acid (e.g., a DETECTR reaction). A device described herein may include a particular microfluidic device (e.g., a pneumatic valve device, a sliding valve device, or a rotating valve device), a lateral flow device, or a sample preparation device. In some embodiments, the method for use of the device, system, fluidic device, or kit for rapid lab tests may comprise some or all of the steps of sample preparation, nucleic acid amplification, programmable nuclease reaction incubation, and detection or readout.

In one aspect, described herein, is a system for detecting a target nucleic acid. The system may comprise a support medium; a guide nucleic acid targeting a target sequence; a programmable nuclease capable of being activated when complexed with the guide nucleic acid and the target sequence; and a single stranded detector nucleic acid comprising a detection moiety, wherein the detector nucleic acid is capable of being cleaved by the activated nuclease, thereby generating a first detectable signal.

In another aspect, described herein is a system for detecting a target nucleic acid, the system comprising a reagent chamber and a support medium for detection of the first detectable signal. The reagent chamber comprises a guide nucleic acid targeting a target sequence; a programmable nuclease capable of being activated when complexed with the guide nucleic acid and the target sequence; and a single stranded detector nucleic acid comprising a detection moiety, wherein the detector nucleic acid is capable of being cleaved by the activated nuclease, thereby generating a first detectable signal.

Further described herein is a method of detecting a target nucleic acid in a sample comprising contacting the sample with a guide nucleic acid targeting a target sequence, a programmable nuclease capable of being activated when complexed with the guide nucleic acid and the target sequence, a single stranded detector nucleic acid comprising a detection moiety, wherein the detector nucleic acid is capable of being cleaved by the activated nuclease, thereby generating a first detectable signal, and presenting the first detectable signal using a support medium. The method is applicable for use in the devices disclosed herein, for example in a pneumatic valve device, a sliding valve device, a rotating valve device, or a lateral flow device.

Also described herein are various designs of assays for programmable nuclease diagnostics, such as CRISPR-Cas diagnostics. The design and format of the lateral flow assays disclosed herein can include reporters, which can be tethered to the surface of a reaction chamber that is upstream of the lateral flow strip itself. The assay designs disclosed herein provide significant advantages as they minimize the chances of false positives, and thus can have improved sensitivity and specificity for a target nucleic acid.

Also described herein is a kit for detecting a target nucleic acid. The kit may comprise a support medium; a guide nucleic acid targeting a target sequence; a programmable nuclease capable of being activated when complexed with the guide nucleic acid and the target sequence; and a single stranded detector nucleic acid comprising a detection moiety, wherein the detector nucleic acid is capable of being cleaved by the activated nuclease, thereby generating a first detectable signal.

The kits described herein may be used for detecting in a biological sample the presence or absence of a target nucleic acid. In some aspects, a biological sample from an individual or an environmental sample can be tested to determine whether the individual has a communicable disease. The biological sample can be tested to detect the presence or absence of at least one target nucleic acid from a *bacterium* or a virus or a pathogen responsible for the disease. The at least one target nucleic acid from a *bacterium* or a pathogen responsible for the disease that is detected can also indicate that the *bacterium* or pathogen is wild-type or comprises a mutation that confers resistance to treatment, such as antibiotic treatment. The biological sample can be tested to detect the presence or absence of at least one target nucleic acid expressed in a cancer or genetic disorder. A sample from an individual or from an environment is applied to the reagents described herein. The reaction between the sample and the reagents may be performed in the reagent chamber provided in the kit or on a support medium provided in the kit. If the target nucleic acid is present in the sample, the target nucleic acid binds to the guide nucleic acid to activate the programmable nuclease. The activated programmable nuclease cleaves the detector nucleic acid and generates a detectable signal that can be visualized on the support medium. If the target nucleic acid is absent in the sample or below the threshold of detection, the guide nucleic acid remains unbound, the programmable nuclease remains inactivated, and the detector nucleic acid remains uncleaved. After the sample and the reagents are contacted for a predetermined time, the reacted sample is placed on a sample pad of a support medium. The sample can be placed on to the sample pad by dipping the support medium into the reagent chamber, applying the reacted sample to the sample pad, or allowing the sample to transport if the reagent was initially placed on the support medium. As the reacted sample and reagents move along the support medium to a detection region and after a predetermined amount of time after applying the reacted sample, a positive control marker can be visualized in the detection region. If the sample is positive for the target nucleic acid, a test marker for the detectable signal can also be visualized. The results in the detection region can be visualized by eye or using a mobile device. In some instances, an individual can open a mobile application for reading of the test results on a mobile device having a camera and take an image of the support medium, including the detection region, barcode, reference color scale, and fiduciary markers on the housing, using the camera of the mobile device and the graphic user interface (GUI) of the mobile application. The mobile application can identify the test, visualize the detection region in the image, and analyze to determine the presence or absence or the level of the target nucleic acid responsible for the disease, cancer, or genetic disorder. The mobile application can present the results of the test to the individual, store the test results in the mobile application, or communicate with a remote device and transfer the data of the test results.

Such devices, systems, fluidic devices, kits, and methods described herein may allow for detection of target nucleic acid, and in turn the pathogen and disease associated with the target nucleic acid or the cancer or genetic disorder associated with the target nucleic acid, in remote regions or low resource settings without specialized equipment. Also, such devices, systems, fluidic devices, kits, and methods described herein may allow for detection of target nucleic acid, and in turn the pathogen and disease associated with the target nucleic acid or the cancer or genetic disorder associated with the target nucleic acid, in healthcare clinics or doctor offices without specialized equipment. In some cases, this provides a point of care testing for users to easily test for a disease, cancer, or genetic disorder at home or quickly in an office of a healthcare provider. For example, a microfluidic device (e.g., a pneumatic valve device, a sliding valve device, or a rotating valve device) or a lateral flow device disclosed herein may be used in combination with reagents and methods disclosed herein to detect the presence or absence of a target nucleic acid associated with a disease or pathogen in a biological sample rapidly and without specialized equipment. Assays that deliver results in under an hour, for example, in from 15 to 60 minutes, are particularly desirable for at home testing for many reasons. Antivirals can be most effective when administered within the first 48 hours and improve antiviral stewardship. Thus, the systems and assays disclosed herein, which are capable of delivering results in under an hour can will allow for the delivery of anti-viral therapy at an optimal time. Additionally, the systems and assays provided herein, which are capable of delivering quick diagnoses and results, can help keep or send a patient at home, improve comprehensive disease surveillance, and prevent the spread of an infection. In other cases, this provides a test, which can be used in a lab to detect a nucleic acid of interest in a sample from a subject. In particular, provided herein are devices, systems, fluidic devices, and kits, wherein the rapid lab tests can be performed in a single system. In some cases, this may be valuable in detecting diseases and pathogens, cancer, or a genetic disorder in a developing country and as a global healthcare tool to detect the spread of a disease or efficacy of a treatment or provide early detection of a cancer or genetic disorder.

To detect a target nucleic acid (e.g., a target nucleic acid associated with a disease), some methods as described herein use an editing technique, such as a technique using an editing enzyme or a programmable nuclease and guide nucleic acid. Methods comprising editing techniques may be used in combination with the microfluidic devices, lateral flow devices, sample preparation devices, and compositions (e.g., programmable nucleases, guide RNAs, reagents for in vitro transcription, amplification, reverse transcription, and reporters, or any combination thereof) described herein. An editing enzyme or a programmable nuclease in the editing technique can be activated by a target nucleic acid, after which the activated editing enzyme or activated programmable nuclease can cleave nearby single-stranded nucleic acids, such detector nucleic acids with a detection moiety. A target nucleic acid from a marker, such as a disease or cancer marker, can be amplified by isothermal amplification and then an editing technique can be used to detect the marker. In some instances, the editing technique can comprise an editing enzyme or programmable nuclease that, when activated, cleaves nearby RNA or DNA as the readout of the detection. The methods as described herein in some instances comprise obtaining a cell-free DNA sample, amplifying DNA from the sample, using an editing technique to cleave detector nucleic acids, and reading the output of the editing technique. In other instances, the method comprises obtaining a fluid sample from a patient, and without amplifying a nucleic acid of the fluid sample, using an editing technique to cleave detector nucleic acids, and detecting the nucleic acid. The method can also comprise using single-stranded detector DNA, cleaving the single-stranded detector DNA using an activated editing enzyme, wherein the editing enzyme cleaves at least 50% of a population of single-stranded detector DNA as measured by a change in color. A number of samples, guide nucleic acids, programmable nucleases or editing enzymes, support mediums, target nucleic acids, single-stranded detector nucleic acids, and reagents are consistent with the devices, systems, fluidic devices, kits, and methods disclosed herein.

Also disclosed herein are detector nucleic acids (which can also be referred to as reporters) and methods detecting a target nucleic using the detector nucleic acids. The detector nucleic acids disclosed herein are applicable in the methods and devices (e.g., microfluidic devices and lateral flow devices) disclosed herein. Often, the detector nucleic acid is a protein-nucleic acid, wherein the protein can allow for detection of a signal (e.g., the protein is an enzyme and produces a detectable signal when contacting its substrate or the protein is a substrate and produces a detectable signal when contacting its enzyme). For example, a method of assaying for a target nucleic acid in a sample comprises contacting the sample to a complex comprising a guide nucleic acid comprising a segment that is reverse complementary to a segment or portion of the target nucleic acid and a programmable nuclease that exhibits sequence independent cleavage upon forming a complex comprising the segment or portion of the guide nucleic acid binding to the segment or portion of the target nucleic acid; and assaying for a signal indicating cleavage of at least some protein-nucleic acids of a population of protein-nucleic acids, wherein the signal indicates a presence of the target nucleic acid in the sample and wherein absence of the signal or a presence of the signal near background indicates an absence of the target nucleic acid in the sample. Often, the protein-nucleic acid is an enzyme-nucleic acid or an enzyme substrate-nucleic acid. Sometimes, the protein-nucleic acid is attached to a solid support. The nucleic acid can be DNA, RNA, or a DNA/RNA hybrid.

The methods described herein use a programmable nuclease, such as the CRISPR/Cas system, to detect a target nucleic acid. A method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal or a presence of the signal near background indicates an absence of the target nucleic acid in the sample. Often, the substrate is an enzyme-nucleic acid. Sometimes, the substrate is an enzyme substrate-nucleic acid.

Cleavage of the protein-nucleic acid produces a signal. For example, cleavage of the protein-nucleic acid produces a calorimetric signal, a potentiometric signal, an amperometric signal, an optical signal, or a piezo-electric signal. Various devices can be used to detect these different types of signals, which indicate whether a target nucleic acid is present in the sample.

The present disclosure provides methods of assaying for a target nucleic acid as described herein. For example, a method of assaying for a target nucleic acid in a sample comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal or a presence of the signal near background indicates an absence of the target nucleic acid in the sample. As another example, a method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal or a presence of the signal near background indicates an absence of the target nucleic acid in the sample. Often, the substrate is an enzyme-nucleic acid. Sometimes, the substrate is an enzyme substrate-nucleic acid. The methods of assaying for a target nucleic acid in a sample disclosed herein are particularly suited for use in conjunction with the devices and compositions disclosed herein.

Sample

A number of samples are consistent with the devices, systems, fluidic devices, kits, and methods disclosed herein. These samples are, for example, consistent with fluidic devices disclosed herein for detection of a target nucleic acid within the sample, wherein the fluidic device may comprise multiple pumps, valves, reservoirs, and chambers for sample preparation, amplification of a target nucleic acid within the sample, mixing with a programmable nuclease, and detection of a detectable signal arising from cleavage of detector nucleic acids by the programmable nuclease within the fluidic system itself. These samples can comprise a target nucleic acid for detection of an ailment, such as a disease, cancer, or genetic disorder, or genetic information, such as for phenotyping, genotyping, or determining ancestry and are compatible with the reagents and support mediums as described herein. Generally, a sample from an individual or an animal or an environmental sample can be obtained to test for presence of a disease, cancer, genetic disorder, or any mutation of interest. A biological sample from the individual may be blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. A tissue sample may be dissociated or liquified prior to application to detection system of the present disclosure. A sample from an environment may be from soil, air, or water. In some instances, the environmental sample is taken as a swab from a surface of interest or taken directly from the surface of interest. In some instances, the raw sample is applied to the detection system. In some instances, the sample is diluted with a buffer or a fluid or concentrated prior to application to the detection system or be applied neat to the detection system. Sometimes, the sample is contained in no more 20 µl. The sample, in some cases, is contained in no more than 1, 5, 10, 15, 20, 25, 30, 35 40, 45, 50, 55, 60, 65, 70, 75, 80, 90, 100, 200, 300, 400, 500 µl, or any of value from 1 µl to 500 µl. In some cases, the sample is contained in from 1 µL to 500 µL, from 10 µL to 500 µL, from 50 µL to 500 µL, from 100 µL to 500 µL, from 200 µL to 500 µl, from 300 µL to 500 µL, from 400 µL to 500 µL, from 1 µL to 200 µL, from 10 µL to 200 µL, from 50 µL to 200 µL, from 100 µL to 200 µL, from 1 µL to 100 µL, from 10 µL to 100 µL, from 50 µL to 100 µL, from 1 µL to 50 µL, from 10 µL to 50 µL, from 1 µL to 20 µL, from 10 µL to 20 µL, or from 1 µL to 10 µL. Sometimes, the sample is contained in more than 500 µl.

In some instances, the sample is taken from single-cell eukaryotic organisms; a plant or a plant cell; an algal cell; a fungal cell; an animal cell, tissue, or organ; a cell, tissue, or organ from an invertebrate animal; a cell, tissue, fluid, or organ from a vertebrate animal such as fish, amphibian, reptile, bird, and mammal; a cell, tissue, fluid, or organ from a mammal such as a human, a non-human primate, an ungulate, a feline, a bovine, an ovine, and a caprine. In some instances, the sample is taken from nematodes, protozoans, helminths, or malarial parasites. In some cases, the sample comprises nucleic acids from a cell lysate from a eukaryotic cell, a mammalian cell, a human cell, a prokaryotic cell, or a plant cell. In some cases, the sample comprises nucleic acids expressed from a cell.

The sample used for disease testing may comprise at least one target sequence that can bind to a guide nucleic acid of the reagents described herein. In some cases, the target sequence is a portion of a nucleic acid. A nucleic acid can be from a genomic locus, a transcribed mRNA, or a reverse transcribed cDNA. A nucleic acid can be from 5 to 100, 5 to 90, 5 to 80, 5 to 70, 5 to 60, 5 to 50, 5 to 40, 5 to 30, 5 to 25, 5 to 20, 5 to 15, or 5 to 10 nucleotides in length. A nucleic acid can be from 10 to 90, from 20 to 80, from 30 to 70, or from 40 to 60 nucleotides in length. A nucleic acid sequence can be from 10 to 95, from 20 to 95, from 30 to 95, from 40 to 95, from 50 to 95, from 60 to 95, from 10 to 75, from 20 to 75, from 30 to 75, from 40 to 75, from 50 to 75, from 5 to 50, from 15 to 50, from 25 to 50, from 35 to 50, or from 45 to 50 nucleotides in length. A nucleic acid can be 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 60, 70, 80, 90, or 100 nucleotides in length. The target nucleic acid can be reverse complementary to a guide nucleic acid. In some cases, at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 45, 50, 60, 70, 80, 90, or 100 nucleotides of a guide nucleic acid can be reverse complementary to a target nucleic acid.

In some cases, the target sequence is a portion of a nucleic acid from a virus or a *bacterium* or other agents responsible for a disease in the sample. The target sequence, in some cases, is a portion of a nucleic acid from a sexually transmitted infection or a contagious disease, in the sample. The target sequence, in some cases, is a portion of a nucleic acid from an upper respiratory tract infection, a lower respiratory tract infection, or a contagious disease, in the sample. The target sequence, in some cases, is a portion of a nucleic acid from a hospital acquired infection or a contagious disease, in the sample. The target sequence, in some cases, is a portion of a nucleic acid from sepsis, in the sample. These diseases may include but are not limited to human immunodeficiency virus (HIV), human papillomavirus (HPV), *chlamydia*, gonorrhea, syphilis, trichomoniasis, sexually transmitted infection, malaria, Dengue fever, Ebola, chikungunya, and leishmaniasis. Pathogens include viruses, fungi, helminths, protozoa, malarial parasites, *Plasmodium* parasites, *Toxoplasma* parasites, and *Schistosoma* parasites. Helminths include roundworms, heartworms, and phytophagous nematodes, flukes, *Acanthocephala*, and tapeworms. Protozoan infections include infections from *Giardia* spp., *Trichomonas* spp., African trypanosomiasis, amoebic dysentery, babesiosis, balantidial dysentery, Chaga's disease, coccidiosis, malaria and toxoplasmosis. Examples of pathogens such as parasitic/protozoan pathogens include, but are not limited to: *Plasmodium falciparum, P. vivax, Trypanosoma cruzi* and *Toxoplasma gondii*. Fungal pathogens include, but are not limited to *Cryptococcus neoformans, Histoplasma capsulatum, Coccidioides immitis, Blastomyces dermatitides, Chlamydia trachomatis*, and *Candida albicans*. Pathogenic viruses include but are not limited to immunodeficiency virus (e.g., HIV); influenza virus; dengue; West Nile virus; herpes virus; yellow fever virus; Hepatitis Virus C; Hepatitis Virus A; Hepatitis Virus B; papillomavirus; and the like. Pathogens include, e.g., HIV virus, *Mycobacterium tuberculosis, Klebsiella pneumoniae, Acinetobacter baumannii, Burkholderia cepacia, Streptococcus agalactiae*, methicillin-resistant *Staphylococcus aureus, Legionella pneumophila, Streptococcus pyogenes, Escherichia coli, Neisseria gonorrhoeae, Neisseria meningitidis*, Pneumococcus, *Cryptococcus neoformans, Histoplasma capsulatum, Hemophilus influenzae* B, *Treponema pallidum*, Lyme disease spirochetes, *Pseudomonas aeruginosa, Mycobacterium leprae, Brucella abortus*, rabies virus, influenza virus, cytomegalovirus, herpes simplex virus I, herpes simplex virus II, human serum parvo-like virus, respiratory syncytial virus (RSV), *M. genitalium, T. Vaginalis*, varicella-zoster virus, hepatitis B virus, hepatitis C virus, measles virus, adenovirus, human T-cell leukemia viruses, Epstein-Barr virus, murine leukemia virus, mumps virus, vesicular stomatitis virus, Sindbis virus, lymphocytic choriomeningitis virus, wart virus, blue tongue virus, Sendai virus, feline leukemia virus, Reovirus, polio virus, simian virus 40, mouse mammary tumor virus, dengue virus, rubella virus, West Nile virus, *Plasmodium falciparum, Plasmodium vivax, Toxoplasma gondii, Trypanosoma rangeli, Trypanosoma cruzi, Trypanosoma rhodesiense, Trypanosoma brucei, Schistosoma mansoni, Schistosoma japonicum, Babesia bovis, Eimeria tenella, Onchocerca volvulus, Leishmania tropica, Mycobacterium tuberculosis, Trichinella spiralis, Theileria parva, Taenia hydatigena, Taenia ovis, Taenia saginata, Echinococcus granulosus, Mesocestoides corti, Mycoplasma arthritidis, M. hyorhinis, M. orale, M. arginini, Acholeplasma laidlawii, M. salivarium, M pneumoniae, Enterobacter cloacae, Kiebsiella aerogenes, Proteus vulgaris, Serratia macesens, Enterococcus faecalis, Enterococcus faecium, Streptococcus intermdius, Streptococcus pneumoniae*, and *Streptococcus pyogenes*. Often the target nucleic acid comprises a sequence from a virus or a *bacterium* or other agents responsible for a disease that can be found in the sample. In some cases, the target nucleic acid is a portion of a nucleic acid from a genomic locus, a transcribed mRNA, or a reverse transcribed cDNA from a gene locus in at least one of: human immunodeficiency virus (HIV), human papillomavirus (HPV), *chlamydia*, gonorrhea, syphilis, trichomoniasis, sexually transmitted infection, malaria, Dengue fever, Ebola, chikungunya, and leishmaniasis. Pathogens include viruses, fungi, helminths, protozoa, malarial parasites, *Plasmodium* parasites, *Toxoplasma* parasites, and *Schistosoma* parasites. Helminths include roundworms, heartworms, and phytophagous nematodes, flukes, *Acanthocephala*, and tapeworms. Protozoan infections include infections from *Giardia* spp., *Trichomonas* spp., African trypanosomiasis, amoebic dysentery, babesiosis, balantidial dysentery, Chaga's disease, coccidiosis, malaria and toxoplasmosis. Examples of pathogens such as parasitic/protozoan pathogens include, but are not limited to: *Plasmodium falciparum, P. vivax, Trypanosoma cruzi* and *Toxoplasma gondii*. Fungal pathogens include, but are not limited to *Cryptococcus neoformans, Histoplasma capsulatum, Coccidioides immitis, Blastomyces dermatitidis, Chlamydia trachomatis*, and *Candida albicans*. Pathogenic viruses include but are not limited to immunodeficiency virus (e.g., HIV); influenza virus; dengue; West Nile virus; herpes virus; yellow fever virus; Hepatitis Virus C; Hepatitis Virus A; Hepatitis Virus B; papillomavirus; and the like. Pathogens include, e.g., HIV virus, *Mycobacterium tuberculosis, Streptococcus agalactiae*, methicillin-resistant *Staphylococcus aureus, Legionella pneumophila, Streptococcus pyogenes, Escherichia coli, Neisseria gonorrhoeae, Neisseria meningitidis*, Pneumococcus, *Cryptococcus neoformans, Histoplasma capsulatum, Hemophilus influenzae* B, *Treponema pallidum*, Lyme disease spirochetes, *Pseudomonas aeruginosa, Mycobacterium leprae, Brucella abortus*, rabies virus, influenza virus, cytomegalovirus, herpes simplex virus I, herpes simplex virus II, human serum parvo-like virus, respiratory syncytial virus (RSV), *M. genitalium, T. vaginalis*, varicella-zoster virus, hepatitis B virus, hepatitis C virus, measles virus, adenovirus, human T-cell leukemia viruses, Epstein-Barr virus, murine leukemia virus, mumps virus, vesicular stomatitis virus, Sindbis virus, lymphocytic choriomeningitis virus, wart virus, blue tongue virus, Sendai virus, feline leukemia virus, Reovirus, polio virus, simian virus 40, mouse mammary tumor virus, dengue virus, rubella virus, West Nile virus, *Plasmodium falciparum, Plasmodium vivax, Toxoplasma gondii, Trypanosoma rangeli, Trypanosoma cruzi, Trypanosoma rhodesiense, Trypanosoma brucei, Schistosoma mansoni, Schistosoma japonicum, Babesia bovis, Eimeria tenella, Onchocerca volvulus, Leishmania tropica, Mycobacterium tuberculosis, Trichinella spiralis, Theileria parva, Taenia hydatigena, Taenia ovis, Taenia saginata, Echinococcus granulosus, Mesocestoides corti, Mycoplasma arthritidis, M. hyorhinis, M. orale, M. arginini, Acholeplasma laidlawii, M. salivarium* and *M. pneumoniae*. In some cases, the target sequence is a portion of a nucleic acid from a genomic locus, a transcribed mRNA, or a reverse transcribed cDNA from a gene locus of *bacterium* or other agents responsible for a disease in the sample comprising a mutation that confers resistance to a treatment, such as a single nucleotide mutation that confers resistance to antibiotic treatment.

The sample used for cancer testing may comprise at least one target nucleic acid segment that can bind to a guide nucleic acid of the reagents described herein. The target nucleic acid segment, in some cases, is a portion of a nucleic acid from a gene with a mutation associated with cancer, from a gene whose overexpression is associated with cancer, a tumor suppressor gene, an oncogene, a checkpoint inhibitor gene, a gene associated with cellular growth, a gene associated with cellular metabolism, or a gene associated with cell cycle. Sometimes, the target nucleic acid encodes for a cancer biomarker, such as a prostate cancer biomarker or non-small cell lung cancer. In some cases, the assay can be used to detect "hotspots" in target nucleic acids that can be predictive of lung cancer. In some cases, the target nucleic acid is a portion of a nucleic acid that is associated with a blood fever. In some cases, the target nucleic acid segment is a portion of a nucleic acid from a genomic locus, a transcribed mRNA, or a reverse transcribed cDNA from a locus of at least one of: ALK, APC, ATM, AXIN2, BAP1, BARD1, BLM, BMPR1A, BRCA1, BRCA2, BRIP1, CASR, CDCl73, CDH1, CDK4, CDKN1B, CDKN1C, CDKN2A, CEBPA, CHEK2, CTNNA1, DICER1, DIS3L2, EGFR, EPCAM, FH, FLCN, GATA2, GPC3, GREM1, HOXB13, HRAS, KIT, MAX, MEN1, MET, MITF, MLH1, MSH2, MSH3, MSH6, MUTYH, NBN, NF1, NF2, NTHL1, PALB2, PDGFRA, PHOX2B, PMS2, POLD1, POLE, POT1, PRKAR1A, PTCH1, PTEN, RAD50, RAD51C, RAD51D, RB1, RECQL4, RET, RUNX1, SDHA, SDHAF2, SDHB, SDHC, SDHD, SMAD4, SMARCA4, SMARCB1, SMARCE1, STK11, SUFU, TERC, TERT, TMEM127, TP53, TSC1, TSC2, VHL, WRN, and WT1.

The sample used for genetic disorder testing may comprise at least one target nucleic acid segment that can bind to a guide nucleic acid of the reagents described herein. In some embodiments, the genetic disorder is hemophilia, sickle cell anemia, β-thalassemia, Duchene muscular dystrophy, severe combined immunodeficiency, or cystic fibrosis. The target nucleic acid segment, in some cases, is a portion of a nucleic acid from a gene with a mutation associated with a genetic disorder, from a gene whose overexpression is associated with a genetic disorder, from a gene associated with abnormal cellular growth resulting in a genetic disorder, or from a gene associated with abnormal cellular metabolism resulting in a genetic disorder. In some cases, the target nucleic acid segment is a portion of a nucleic acid from a genomic locus, a transcribed mRNA, or a reverse transcribed cDNA from a locus of at least one of: CFTR, FMR1, SMN1, ABCB11, ABCC8, ABCD1, ACAD9, ACADM, ACADVL, ACAT1, ACOX1, ACSF3, ADA, ADAMTS2, ADGRG1, AGA, AGL, AGPS, AGXT, AIRE, ALDH3A2, ALDOB, ALG6, ALMS1, ALPL, AMT, AQP2, ARG1, ARSA, ARSB, ASL, ASNS, ASPA, ASS1, ATM, ATP6V1B1, ATP7A, ATP7B, ATRX, BBS1, BBS10, BBS12, BBS2, BCKDHA, BCKDHB, BCS1L, BLM, BSND, CAPN3, CBS, CDH23, CEP290, CERKL, CHM, CHRNE, CIITA, CLN3, CLN5, CLN6, CLN8, CLRN1, CNGB3, COL27A1, COL4A3, COL4A4, COL4A5, COL7A1, CPS1, CPT1A, CPT2, CRB1, CTNS, CTSK, CYBA, CYBB, CYP11B1, CYP11B2, CYP17A1, CYP19A1, CYP27A1, DBT, DCLRE1C, DHCR7, DHDDS, DLD, DMD, DNAH5, DNAI1, DNAI2, DYSF, EDA, EIF2B5, EMD, ERCC6, ERCC8, ESCO2, ETFA, ETFDH, ETHE1, EVC, EVC2, EYS, F9, FAH, FAM161A, FANCA, FANCC, FANCG, FH, FKRP, FKTN, G6PC, GAA, GALC, GALK1, GALT, GAMT, GBA, GBE1, GCDH, GFM1, GJB1, GJB2, GLA, GLB1, GLDC, GLE1, GNE, GNPTAB, GNPTG, GNS, GRHPR, HADHA, HAX1, HBA1, HBA2, HBB, HEXA, HEXB, HGSNAT, HLCS, HMGCL, HOGA1, HPS1, HPS3, HSD17B4, HSD3B2, HYAL1, HYLS1, IDS, IDUA, IKBKAP, IL2RG, IVD, KCNJ11, *LAMA2*, *LAMA3*, LAMB3, LAMC2, LCA5, LDLR, LDLRAP1, LHX3, LIFR, LIPA, LOXHD1, LPL, LRPPRC, MAN2B1, MCOLN1, MED17, MESP2, MFSD8, MKS1, MLC1, MMAA, MMAB, MMACHC, MMADHC, MPI, MPL, MPV17, MTHFR, MTM1, MTRR, MTTP, MUT, MYO7A, NAGLU, NAGS, NBN, NDRG1, NDUFAF5, NDUFS6, NEB, NPC1, NPC2, NPHS1, NPHS2, NR2E3, NTRK1, OAT, OPA3, OTC, PAH, PC, PCCA, PCCB, PCDH15, PDHA1, PDHB, PEX1, PEX10, PEX12, PEX2, PEX6, PEX7, PFKM, PHGDH, PKHD1, PMM2, POMGNT1, PPT1, PROP1, PRPS1, PSAP, PTS, PUS1, PYGM, RAB23, RAG2, RAPSN, RARS2, RDH12, RMRP, RPE65, RPGRIP1L, RS1, RTEL1, SACS, SAMHD1, SEPSECS, SGCA, SGCB, SGCG, SGSH, SLC12A3, SLC12A6, SLC17A5, SLC22A5, SLC25A13, SLC25A15, SLC26A2, SLC26A4, SLC35A3, SLC37A4, SLC39A4, SLC4A11, SLC6A8, SLC7A7, SMARCAL1, SMPD1, STAR, SUMF1, TAT, TCIRG1, TECPR2, TFR2, TGM1, TH, TMEM216, TPP1, TRMU, TSFM, TTPA, TYMP, USH1C, USH2A, VPS13A, VPS13B, VPS45, VRK1, VSX2, WNT10A, XPA, XPC, and ZFYVE26.

The sample used for phenotyping testing may comprise at least one target nucleic acid segment that can bind to a guide nucleic acid of the reagents described herein. The target nucleic acid segment, in some cases, is a portion of a nucleic acid from a gene associated with a phenotypic trait.

The sample used for genotyping testing may comprise at least one target nucleic acid segment that can bind to a guide nucleic acid of the reagents described herein. The target nucleic acid segment, in some cases, is a portion of a nucleic acid from a gene associated with a genotype.

The sample used for ancestral testing may comprise at least one target nucleic acid segment that can bind to a guide nucleic acid of the reagents described herein. The target nucleic acid segment, in some cases, is a portion of a nucleic acid from a gene associated with a geographic region of origin or ethnic group.

The sample can be used for identifying a disease status. For example, a sample is any sample described herein, and is obtained from a subject for use in identifying a disease status of a subject. The disease can be a cancer or genetic disorder. Sometimes, a method comprises obtaining a serum sample from a subject; and identifying a disease status of the subject. Often, the disease status is prostate disease status.

In some instances, the target nucleic acid is a single stranded nucleic acid. Alternatively or in combination, the target nucleic acid is a double stranded nucleic acid and is prepared into single stranded nucleic acids before or upon contacting the reagents. The target nucleic acid may be a RNA, DNA, synthetic nucleic acids, or nucleic acids found in biological or environmental samples. The target nucleic acids include but are not limited to mRNA, rRNA, tRNA, non-coding RNA, long non-coding RNA, and microRNA (miRNA). In some cases, the target nucleic acid is mRNA. In some cases, the target nucleic acid is from a virus, a parasite, or a *bacterium* described herein. In some cases, the target nucleic acid is transcribed from a gene as described herein.

A number of target nucleic acids are consistent with the methods and compositions disclosed herein. Some methods described herein can detect a target nucleic acid present in the sample in various concentrations or amounts as a target nucleic acid population. In some cases, the sample has at least 2 target nucleic acids. In some cases, the sample has at least 3, 5, 10, 20, 30, 40, 50, 100, 200, 300, 400, 500, 600, 700, 800, 900, 1000, 2000, 3000, 4000, 5000, 6000, 7000, 8000, 9000, or 10000 target nucleic acids. In some cases, the sample has from 1 to 10,000, from 100 to 8000, from 400 to 6000, from 500 to 5000, from 1000 to 4000, or from 2000 to 3000 target nucleic acids. In some cases, the sample has from 100 to 9500, from 100 to 9000, from 100 to 8500, from 100 to 8000, from 100 to 7500, from 100 to 7000, from 100 to 6500, from 100 to 6000, from 100 to 5500, from 100 to 5000, from 250 to 9500, from 250 to 9000, from 250 to 8500, from 250 to 8000, from 250 to 7500, from 250 to 7000, from 250 to 6500, from 250 to 6000, from 250 to 5500, from 250 to 5000, from 2500 to 9500, from 2500 to 9000, from 2500 to 8500, from 2500 to 8000, from 2500 to 7500, from 2500 to 7000, from 2500 to 6500, from 2500 to 6000, from 2500 to 5500, or from 2500 to 5000 target nucleic acids. In some cases, the method detects target nucleic acid present at least at one copy per $10^1$ non-target nucleic acids, $10^2$ non-target nucleic acids, $10^3$ non-target nucleic acids, $10^4$ non-target nucleic acids, $10^5$ non-target nucleic acids, $10^6$ non-target nucleic acids, $10^7$ non-target nucleic acids, $10^8$ non-target nucleic acids, $10^9$ non-target nucleic acids, or $10^{10}$ non-target nucleic acids.

A number of target nucleic acid populations are consistent with the methods and compositions disclosed herein. Some methods described herein can detect two or more target nucleic acid populations present in the sample in various concentrations or amounts. In some cases, the sample has at least 2 target nucleic acid populations. In some cases, the sample has at least 3, 4, 5, 6, 7, 8, 9, 10, 20, 30, 40, or 50 target nucleic acid populations. In some cases, the sample has from 3 to 50, from 5 to 40, or from 10 to 25 target nucleic acid populations. In some cases, the sample has from 2 to 50, from 5 to 50, from 10 to 50, from 2 to 25, from 3 to 25, from 4 to 25, from 5 to 25, from 10 to 25, from 2 to 20, from 3 to 20, from 4 to 20, from 5 to 20, from 10 to 20, from 2 to 10, from 3 to 10, from 4 to 10, from 5 to 10, from 6 to 10, from 7 to 10, from 8 to 10, or from 9 to 10 target nucleic acid populations. In some cases, the method detects target nucleic acid populations that are present at least at one copy per $10^1$ non-target nucleic acids, $10^2$ non-target nucleic acids, $10^3$ non-target nucleic acids, $10^4$ non-target nucleic acids, $10^5$ non-target nucleic acids, $10^6$ non-target nucleic acids, $10^7$ non-target nucleic acids, $10^8$ non-target nucleic acids, $10^9$ non-target nucleic acids, or $10^{10}$ non-target nucleic acids. The target nucleic acid populations can be present at different concentrations or amounts in the sample.

Additionally, a target nucleic acid can be amplified before binding to a guide nucleic acid, for example a crRNA of a CRISPR enzyme. This amplification can be PCR amplification or isothermal amplification. This nucleic acid amplification of the sample can improve at least one of sensitivity, specificity, or accuracy of the detection the target RNA. The reagents for nucleic acid amplification can comprise a recombinase, a oligonucleotide primer, a single-stranded DNA binding (SSB) protein, and a polymerase. The nucleic acid amplification can be transcription mediated amplification (TMA). Nucleic acid amplification can be helicase dependent amplification (HDA) or circular helicase dependent amplification (cHDA). In additional cases, nucleic acid amplification is strand displacement amplification (SDA). The nucleic acid amplification can be recombinase polymerase amplification (RPA). The nucleic acid amplification can be at least one of loop mediated amplification (LAMP) or the exponential amplification reaction (EXPAR). Nucleic acid amplification is, in some cases, by rolling circle amplification (RCA), ligase chain reaction (LCR), simple method amplifying RNA targets (SMART), single primer isothermal amplification (SPIA), multiple displacement amplification (MDA), nucleic acid sequence based amplification (NASBA), hinge-initiated primer-dependent amplification of nucleic acids (HIP), nicking enzyme amplification reaction (NEAR), or improved multiple displacement amplification (IMDA). The nucleic acid amplification can be performed for no greater than 1, 2, 3, 4, 5, 6, 7, 8, 9, 10, 11, 12, 13, 14, 15, 16, 17, 18, 19, 20, 25, 30, 40, 50, or 60 minutes. Sometimes, the nucleic acid amplification is performed for from 1 to 60, from 5 to 55, from 10 to 50, from 15 to 45, from 20 to 40, or from 25 to 35 minutes. Sometimes, the nucleic acid amplification is performed for from 5 to 60, from 10 to 60, from 15 to 60, from 30 to 60, from 45 to 60, from 1 to 45, from 5 to 45, from 10 to 45, from 30 to 45, from 1 to 30, from 5 to 30, from 10 to 30, from 15 to 30, from 1 to 15, from 5 to 15, or from 10 to 15 minutes. Sometimes, the nucleic acid amplification reaction is performed at a temperature of around 20-45° C. The nucleic acid amplification reaction can be performed at a temperature no greater than 20° C., 25° C., 30° C., 35° C., 37° C., 40° C., 45° C. The nucleic acid amplification reaction can be performed at a temperature of at least 20° C., 25° C., 30° C., 35° C., 37° C., 40° C., or 45° C. In some cases, the nucleic acid amplification reaction is performed at a temperature of from 20° C. to 45° C., from 25° C. to 40° C., from 30° C. to 40° C., or from 35° C. to 40° C. In some cases, the nucleic acid amplification reaction is performed at a temperature of from 20° C. to 45° C., from 25° C. to 45° C., from 30° C. to 45° C., from 35° C. to 45° C., from 40° C. to 45° C., from 20° C. to 37° C., from 25° C. to 37° C., from 30° C. to 37° C., from 35° C. to 37° C., from 20° C. to 30° C., from 25° C. to 30° C., from 20° C. to 25° C., or from 22° C. to 25° C.

Any of the above disclosed samples are consistent with the systems, assays, and programmable nucleases disclosed herein and can be used as a companion diagnostic with any of the diseases disclosed herein (e.g., RSV, sepsis, flu), or can be used in reagent kits, point-of-care diagnostics, or over-the-counter diagnostics.

Reagents

A number of reagents are consistent with the devices, systems, fluidic devices, kits, and methods disclosed herein. These reagents are, for example, consistent for use within various fluidic devices disclosed herein for detection of a target nucleic acid within the sample, wherein the fluidic device may comprise multiple pumps, valves, reservoirs, and chambers for sample preparation, amplification of a target nucleic acid within the sample, mixing with a programmable nuclease, and detection of a detectable signal arising from cleavage of detector nucleic acids by the programmable nuclease within the fluidic system itself. These reagents are compatible with the samples, fluidic devices, methods of detection, and support mediums as described herein for detection of an ailment, such as a disease, cancer, or genetic disorder, or genetic information, such as for phenotyping, genotyping, or determining ancestry. The reagents described herein for detecting a disease, cancer, or genetic disorder comprise a guide nucleic acid targeting the target nucleic acid segment indicative of a disease, cancer, or genetic disorder. Reagents of this disclosure can include guide nucleic acids, substrate nucleic acids, detection reagents, signal reagents, buffers, and programmable nucleases.

Guide Nucleic Acids

Guide nucleic acids are compatible for use in the devices described herein (e.g., pneumatic valve devices, sliding valve devices, rotating valve devices, and lateral flow devices) and may be used in conjunction with compositions disclosed herein (e.g., programmable nucleases, reagents for in vitro transcription, reagents for amplification, reagents for reverse transcription, and reporters, or any combination thereof) to carry out highly efficient, rapid, and accurate reactions for detecting whether a target nucleic acid is present in a sample (e.g., DETECTR reactions). The guide nucleic acid binds to the single stranded target nucleic acid comprising a portion of a nucleic acid from a virus or a *bacterium* or other agents responsible for a disease as described herein. The guide nucleic acid can bind to the single stranded target nucleic acid comprising a portion of a nucleic acid from a *bacterium* or other agents responsible for a disease as described herein and further comprising a mutation, such as a single nucleotide polymorphism (SNP), which can confer resistance to a treatment, such as antibiotic treatment. The guide nucleic acid binds to the single stranded target nucleic acid comprising a portion of a nucleic acid from a cancer gene or gene associated with a genetic disorder as described herein. The guide nucleic acid is complementary to the target nucleic acid. Often the guide nucleic acid binds specifically to the target nucleic acid. The target nucleic acid may be a RNA, DNA, or synthetic nucleic acids. A guide nucleic acid can comprise a sequence that is reverse complementary to the sequence of a target nucleic acid. A guide nucleic acid can be a crRNA. Sometimes, a guide nucleic acid comprises a crRNA and tracrRNA. The guide nucleic acid can bind specifically to the target nucleic acid. In some cases, the guide nucleic acid is not naturally occurring and made by artificial combination of otherwise separate segments of sequence. Often, the artificial combination is performed by chemical synthesis, by genetic engineering techniques, or by the artificial manipulation of isolated segments of nucleic acids. The target nucleic acid can be designed and made to provide desired functions. In some cases, the targeting region of a guide nucleic acid is 20 nucleotides in length. The targeting region of the guide nucleic acid may have a length of at least 10, 11, 12, 13, 14, 15, 16, 17, 18, 19, 20, 21, 22, 23, 24, 25, 26, 27, 28, 29, or 30 nucleotides in length. In some instances, the targeting region of the guide nucleic acid is 10, 11, 12, 13, 14, 15, 16, 17, 18, 19, 20, 21, 22, 23, 24, 25, 26, 27, 28, 29, or 30 nucleotides in length. In some cases, the targeting region of a guide nucleic acid has a length from exactly or about 12 nucleotides (nt) to about 80 nt, from about 12 nt to about 50 nt, from about 12 nt to about 45 nt, from about 12 nt to about 40 nt, from about 12 nt to about 35 nt, from about 12 nt to about 30 nt, from about 12 nt to about 25 nt, from about 12 nt to about 20 nt, from about 12 nt to about 19 nt, from about 19 nt to about 20 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some cases, the targeting region of a guide nucleic acid has a length of from about 10 nt to about 60 nt, from about 20 nt to about 50 nt, or from about 30 nt to about 40 nt. In some cases, the targeting region of a guide nucleic acid has a length of from 15 nt to 55 nt, from 25 nt to 55 nt, from 35 nt to 55 nt, from 45 nt to 55 nt, from 15 nt to 45 nt, from 25 nt to 45 nt, from 35 nt to 45 nt, from 15 nt to 35 nt, from 25 nt to 35 nt, or from 15 nt to 25 nt. It is understood that the sequence of a polynucleotide need not be 100% complementary to that of its target nucleic acid to be specifically hybridizable or hybridizable or bind specifically. The guide nucleic acid can have a sequence comprising at least one uracil in a region from nucleic acid residue 5 to 20 that is reverse complementary to a modification variable region in the target nucleic acid. The guide nucleic acid, in some cases, has a sequence comprising at least one uracil in a region from nucleic acid residue 5 to 9, 10 to 14, or 15 to 20 that is reverse complementary to a modification variable region in the target nucleic acid. The guide nucleic acid can have a sequence comprising at least one uracil in a region from nucleic acid residue 5 to 20 that is reverse complementary to a methylation variable region in the target nucleic acid. The guide nucleic acid, in some cases, has a sequence comprising at least one uracil in a region from nucleic acid residue 5 to 9, 10 to 14, or 15 to 20 that is reverse complementary to a methylation variable region in the target nucleic acid.

The guide nucleic acid can be selected from a group of guide nucleic acids that have been tiled against the nucleic acid of a strain of an infection or genomic locus of interest. The guide nucleic acid can be selected from a group of guide nucleic acids that have been tiled against the nucleic acid of a strain of HPV 16 or HPV18. Often, guide nucleic acids that are tiled against the nucleic acid of a strain of an infection or genomic locus of interest can be pooled for use in a method described herein. Often, these guide nucleic acids are pooled for detecting a target nucleic acid in a single assay. The pooling of guide nucleic acids that are tiled against a single target nucleic acid can enhance the detection of the target nucleic using the methods described herein. The pooling of guide nucleic acids that are tiled against a single target nucleic acid can ensure broad coverage of the target nucleic acid within a single reaction using the methods described herein. The tiling, for example, is sequential along the target nucleic acid. Sometimes, the tiling is overlapping along the target nucleic acid. In some instances, the tiling comprises gaps between the tiled guide nucleic acids along the target nucleic acid. In some instances the tiling of the guide nucleic acids is non-sequential. Often, a method for detecting a target nucleic acid comprises contacting a target nucleic acid to a pool of guide nucleic acids and a programmable nuclease, wherein a guide nucleic acid of the pool of guide nucleic acids has a sequence selected from a group of tiled guide nucleic acid that is reverse complementary to a sequence of a target nucleic acid; and assaying for a signal produce by cleavage of at least some detector nucleic acids of a population of detector nucleic acids. Pooling of guide nucleic acids can ensure broad spectrum identification, or broad coverage, of a target species within a single reaction. This can be particularly helpful in diseases or indications, like sepsis, that may be caused by multiple organisms.

Programmable Nucleases

Programmable nucleases described herein are compatible for use in the devices described herein (e.g., pneumatic valve devices, sliding valve devices, rotating valve devices, and lateral flow devices) and may be used in conjunction with compositions disclosed herein (e.g., guide nucleic acids, reagents for in vitro transcription, reagents for amplification, reagents for reverse transcription, reporters, or any combination thereof) to carry out highly efficient, rapid, and accurate reactions for detecting whether a target nucleic acid is present in a sample (e.g., DETECTR reactions). A programmable nuclease can comprise a programmable nuclease capable of being activated when complexed with a guide nucleic acid and target nucleic acid. The programmable nuclease can become activated after binding of a guide nucleic acid with a target nucleic acid, in which the activated programmable nuclease can cleave the target nucleic acid and can have trans cleavage activity. Trans cleavage activity can be non-specific cleavage of nearby single-stranded nucleic acids by the activated programmable nuclease, such as trans cleavage of detector nucleic acids with a detection moiety. Once the detector nucleic acid is cleaved by the activated programmable nuclease, the detection moiety can be released from the detector nucleic acid and can generate a signal. A signal can be a calorimetric, potentiometric, amperometric, optical (e.g., fluorescent, colorometric, etc.), or piezo-electric signal. Often, the signal is present prior to detector nucleic acid cleavage and changes upon detector nucleic acid cleavage. Sometimes, the signal is absent prior to detector nucleic acid cleavage and is present upon detector nucleic acid cleavage. The detectable signal can be immobilized on a support medium for detection. The programmable nuclease can be a CRISPR-Cas (clustered regularly interspaced short palindromic repeats—CRISPR associated) nucleoprotein complex with trans cleavage activity, which can be activated by binding of a guide nucleic acid with a target nucleic acid. The CRISPR-Cas nucleoprotein complex can comprise a Cas protein (also referred to as a Cas nuclease) complexed with a guide nucleic acid, which can also be referred to as CRISPR enzyme. A guide nucleic acid can be a CRISPR RNA (crRNA). Sometimes, a guide nucleic acid comprises a crRNA and a trans-activating crRNA (tracrRNA).

The CRISPR/Cas system used to detect a modified target nucleic acids can comprise CRISPR RNAs (crRNAs), trans-activating crRNAs (tracrRNAs), Cas proteins, and detector nucleic acids.

Described herein are reagents comprising a programmable nuclease capable of being activated when complexed with the guide nucleic acid and the target nucleic acid segment or portion. A programmable nuclease can be capable of being activated when complexed with a guide nucleic acid and the target sequence. The programmable nuclease can be activated upon binding of the guide nucleic acid to its target nucleic acid and degrades non-specifically nucleic acid in its environment. The programmable nuclease has trans cleavage activity once activated. A programmable nuclease can be a Cas protein (also referred to, interchangeably, as a Cas nuclease). A crRNA and Cas protein can form a CRISPR enzyme.

Several programmable nucleases are consistent with the methods and devices of the present disclosure. For example, CRISPR/Cas enzymes are programmable nucleases used in the methods and systems disclosed herein. CRISPR/Cas enzymes can include any of the known Classes and Types of CRISPR/Cas enzymes. Programmable nucleases disclosed herein include Class 1 CRISPR/Cas enzymes, such as the Type I, Type IV, or Type III CRISPR/Cas enzymes. Programmable nucleases disclosed herein also include the Class 2 CRISPR/Cas enzymes, such as the Type II, Type V, and Type VI CRISPR/Cas enzymes. Preferable programmable nucleases included in the several devices disclosed herein (e.g., a microfluidic device such as a pneumatic valve device or a sliding valve device or a lateral flow assay) and methods of use thereof include a Type V or Type VI CRISPR/Cas enzyme.

In some embodiments, the Type V CRISPR/Cas enzyme is a programmable Cas12 nuclease. Type V CRISPR/Cas enzymes (e.g., Cas12 or Cas14) lack an HNH domain. A Cas12 nuclease of the present disclosure cleaves a nucleic acids via a single catalytic RuvC domain. The RuvC domain is within a nuclease, or "NUC" lobe of the protein, and the Cas12 nucleases further comprise a recognition, or "REC" lobe. The REC and NUC lobes are connected by a bridge helix and the Cas12 proteins additionally include two domains for PAM recognition termed the PAM interacting (PI) domain and the wedge (WED) domain. (Murugan et al., Mol Cell. 2017 Oct. 5; 68(1): 15-25). A programmable Cas12 nuclease can be a Cas12a (also referred to as Cpf1) protein, a Cas12b protein, Cas12c protein, Cas12d protein, or a Cas12e protein. In some cases, a suitable Cas12 protein comprises an amino acid sequence having at least 80%, at least 85%, at least 90%, at least 95%, at least 98%, at least 99%, or 100%, amino acid sequence identity to any one of SEQ ID NO: 145-SEQ ID NO: 155.

TABLE 1

Cas12 Protein Sequences

| SEQ ID NO | Description | Sequence |
|---|---|---|
| 145 | Lachnospiraceae bacterium ND2006 (LbCas12a) | MSKLEKFTNCYSLSKTLRFKAIPVGKTQENIDNKRLLVEDEKRAEDYKGV KKLLDRYYLSFINDVLHSIKLKNLNNYISLFRKKTRTEKENKELENLEINLR KEIAKAFKGNEGYKSLFKKDIIETILPEFLDDKDEIALVNSFNGFTTAFTGF FDNRENMFSEEAKSTSIAFRCINENLTRYISNMDIFEKVDAIFDKHEVQEIK EKILNSDYDVEDFFEGEFFNFVLTQEGIDVYNAIIGGFVTESGEKIKGLNEY INLYNQKTKQKLPKFKPLYKQVLSDRESLSFYGEGYTSDEEVLEVFRNTL NKNSEIFSSIKKLEKLFKNFDEYSSAGIFVKNGPAISTISKDIFGEWNVIRDK WNAEYDDIHLKKKAVVTEKYEDDRRKSFKKIGSFSLEQLQEYADADLSV VEKLKEIIIQKVDEIYKVYGSSEKLFDADFVLEKSLKKNDAVVAIMKDLLD SVKSFENYIKAFFGEGKETNRDESFYGDFVLAYDILLKVDHIYDAIRNYVT QKPYSKDKFKLYFQNPQFMGGWDKDKETDYRATILRYGSKYYLAIMDK KYAKCLQKIDKDDVNGNYEKINYKLLPGPNKMLPKVFFSKKWMAYYNP SEDIQKIYKNGTFKKGDMFNLNDCHKLIDFFKDSISRYPKWSNAYDFNFSE TEKYKDIAGFYREVEEQGYKVSFESASKKEVDKLVEEGKLYMFQIYNKD FSDKSHGTPNLHTMYFKLLFDENNHGQIRLSGGAELFMRRASLKKEELVV HPANSPIANKNPDNPKKTTTLSYDVYKDKRFSEDQYELHIPIAINKCPKNIF KINTEVRVLLKHDDNPYVIGIDRGERNLLYIVVVDGKGNIVEQYSLNEIIN NFNGIRIKTDYHSLLDKKEKERFEARQNWTSIENIKELKAGYISQVVHKIC ELVEKYDAVIALEDLNSGFKNSRVKVEKQVYQKFEKMLIDKLNYMVDK KSNPCATGGALKGYQITNKFESFKSMSTQNGFIFYIPAWLTSKIDPSTGFV NLLKTKYTSIADSKKFISSFDRIMYVPEEDLFEFALDYKNFSRTDADYIKK WKLYSYGNRIRIFRNPKKNNVFDWEEVCLTSAYKELFNKYGINYQQGDIR ALLCEQSDKAFYSSFMALMSLMLQMRNSITGRTDVDFLISPVKNSDGIFY DSRNYEAQENAILPKNADANGAYNIARKVLWAIGQFKKAEDEKLDKVKI AISNKEWLEYAQTSVKH |

TABLE 1-continued

Cas12 Protein Sequences

| SEQ ID NO | Description | Sequence |
|---|---|---|
| 146 | *Acidaminococcus* sp. BV316 (AsCas12a) | MTQFEGFTNLYQVSKTLRFELIPQGKTLKHIQEQGFIEEDKARNDHYKELK PIIDRIYKTYADQCLQLVQLDWENLSAAIDSYRKEKTEETRNALIEEQATY RNAIHDYFIGRTDNLTDAINKRHAEIYKGLFKAELFNGKVLKQLGTVTTTE HENALLRSFDKFTTYFSGFYENRKNVFSAEDISTAIPHRIVQDNPFPKFKENC HIFTRLITAVPSLREHFENVKKAIGIFVSTSIEEVFSFPFYNQLLTQTQIDLYN QLLGGISREAGTEKIKGLNEVLNLAIQKNDETAHIIASLPHRFIPLFKQILSD RNTLSFILEEFKSDEEVIQSFCKYKTLLRNENVLETAEALFNELNSIDLTHIF ISHKKLETISSALCDHWDTLRNALYERRISELTGKITKSAKEKVQRSLKHE DINLQEIISAAGKELSEAFKQKTSEILSHAHAALDQPLPTTLKKQEEKEILK SQLDSLLGYHLLDWFAVDESNEVDPEFSARLTGIKLEMEPSLSFYNKAR NYATKKPYSVEKFKLNFQMPTLASGWDVNKEKNNGAILFVKNGLYYLGI MPKQKGRYKALSFEPTEKTSEGFDKMYYDYFPDAAKMIPKCSTQLKAVT AHFQTHTTPILLSNNFIEPLEITKEIYDLNNPEKEPKKFQTAYAKKTGDQKG YREALCKWIDFTRDFLSKYTKTTSIDLSSLRPSSQYKDLGEYYAELNPLLY HISFQRIAEKEIMDAVETGKLYLFQIYNKDFAKGHHGKPNLHTLYWTGLF SPENLAKTSIKLNGQAELFYRPKSRMKRMAHRLGEKMLNKKLKDQKTPI PDTLYQELYDYVNHRLSHDLSDEARALLPNVITKEVSHEIIKDRRFTSDKF FFHVPITLNYQAANSPSKFNQRVNAYLKEHPETPIIGIDRGERNLIYITVIDS TGKILEQRSLNTIQQFDYQKKLDNREKERVAARQAWSVVGTIKDLKQGY LSQVIHEIVDLMIHYQAVVVLENLNFGFKSKRTGIAEKAVYQQFEKMLID KLNCLVLKDYPAEKVGGVLNPYQLTDQFTSFAKMGTQSGFLFYVPAPYT SKIDPLTGFVDPFVWKTIKNHESRKHFLEGFDFLHYDVKTGDFILHFKMN RNLSFQRGLPGFMPAWDIVFEKNETQFDAKGTPFIAGKRIVPVIENHRFTG RYRDLYPANELIALLEEKGIVFRDGSNILPKLLENDDSHAIDTMVALIRSVL QMRNSNAATGEDYINSPVRDLNGVCFDSRFQNPEWPMDADANGAYHIA LKGQLLLNHLKESKDLKLQNGISNQDWLAYIQELRN |
| 147 | *Francisella novicida* U112 (FnCas12a) | MSIYQEFVNKYSLSKTLRFELIPQGKTLENIKARGLILDDEKRAKDYKKAK QIIDKYHQFFIEEILSSVCISEDLLQNYSDVYFKLKKSDDDNLQKDFKSAKD TIKKQISEYIKDSEKFKNLFNQNLIDAKKGQESDLILWLKQSKDNGIELFKA NSDITDIDEALEIIKSFKGWTTYFKGFHENRKNVYSSNDIPTSITYRIVDDNL PKFLENKAKYESLKDKAPEAINYEQIKKDLAEELTFDIDYKTSEVNQRVFS LDEVFEIANFNNYLNQSGITKFNTIIGGKFVNGENTKRKGINEYINLYSQQI NDKTLKKYKMSVLFKQILSDTESKSFVIDKLEDDSDVVTTMQSFYEQIAA FKTVEEKSIKETLSLLFDDLKAQKLDLSKIYFKNDKSLTDLSQQVFDDYSV IGTAVLEYITQQIAPKNLDNPSKKEQELIAKKTEKAKYLSLETIKLALEEFN KHRDIDKQCRFEEILANFAAIPMIFDEIAQNKDNLAQISIKYQNQGKKDLL QASAEDDVKAIKDLLDQTNNLLHKLKIFHISQSEDKANILDKDEHFYLVFE ECYFELANIVPLYNKIRNYITQKPYSDEKFKLNFENSTLANGWDKNKEPD NTAILFIKDDKYYLGVMNKKNNKIFDDKAIKENKGEGYKKIVYKLLPGAN KMLPKVFFSAKSIKFYNPSEDILRIRNHSTHTKNGSPQKGYEKFEFNIEDCR KFIDFYKQSISKHPEWKDFGFRFSDTQRYNSIDEFYREVENQGYKLTFENIS ESYIDSVVNQGKLYLFQIYNKDFSAYSKGRPNLHTLYWKALFDERNLQD VVYKLNGEAELFYRKQSIPKKITHPAKEAIANKNKDNPKKESVFEYDLIK DKRFTEDKFFFHCPITINFKSSGANKFNDEINLLLKEKANDVHILSIDRGER HLAYYTLVDGKGNIIKQDTFNIIGNDRMKTNYHDKLAAIEKDRDSARKD WKKINNIKEMKEGYLSQVVHEIAKLVIEYNAIVVFEDLNFGFKRGRFKVE KQVYQKLEKMLIEKLNYLVFKDNEFDKTGGVLRAYQLTAPFETFKKMGK QTGITYYVPAGFTSKICPVTGFVNQLYPKYESVSKSQEFFSKFDKICYNLDK GYFEFSFDYKNFGDKAAKGKWTIASFGSRLINFRNSDKNHNWDTREVYP TKELEKLLKDYSIEYGHGECIKAAICGESDKKFFAKLTSVLNTILQMRNSK TGTELDYLISPVADVNGNFFDSRQAPKNMPQDADANGAYHIGLKGLMLL GRIKNNQEGKKLNLVIKNEEYFEFVQNRNN |
| 148 | *Porphyromonas macacae* (PmCas12a) | MKTQHFFEDFTSLYSLSKTIRFELKPIGKTLENIKKNGLIRRDEQRLDDYEK LKKVIDEYHEDFIANILSSFSFSEEILQSYIQNLSESEARAKIEKTMRDTLAK AFSEDERYKSIFKKELVKKDIPVWCPAYKSLCKKFDNFTTSLVPPHENRK NLYTSNEITASIPYRIVHVNLPKFIQNIEALCELQKKMGADLYLEMMENLR NVWPSFVKTPDDLCNLKTYNHLMVQSSISEYNRFVGGYSTEDGTKHQGI NEWINIYRQRNKEMRLPGLVFLHKQILAKVDSSSFISDTLENDDQVFCVLR QFRKLFWNTVSSKEDDAASLKDLFCGLSGYDPEAIYVSDAHLATISKNIFD RWNYISDAIRRKTEVLMPRKKESVERYAEKISKQIKKRQSYSLAELDDLL AHYSEESLPAGFSLLSYFTSLGGQKYLVSDGEVILYEEGSNIWDEVLIAFR DLQVILDKDFTEKKLGKDEEAVSVIKKALDSALRLRKFFDLLSGTGAEIRR DSSFYALYTDRMDKLKGLLKMYDKVRNYLTKKPYSIEKFKLHFDNPSLL SGWDKNKELNNLSVIFRQNGYYYLGIMTPKGKNLFKTLPKLGAEEMFYE KMEYKQIAEPMLMLPKVFFPPKKTKPAFAPDQSVVDIYNKKTFKTGQKGF NKKDLYRLIDFYKEALTVHEWKLFNFSFSPTEQYRNIGEFFDEVREQAYK VSMVNVPASYIDEAVENGKLYLFQIYNKDFSPYSKGIPNLHTLYWKALFS EQNQSRVYKLCGGGELFYRKASLHMQDTTVHPKGISIHKKNLNKKGETS LFNYDLVKDKRFTEDKFFFHVPISINYKNKKITNVNQMVRDYIAQNDDLQ IIGIDRGERNLLYISRIDTRGNLLEQFSLNVIESDKGDLRTDYQKILGDREQE RLRRRQEWKSIESIKDLKDGYMSQVVHKICNMVVEHKAIVVLENLNLSF MKGRKKVEKSVYEKFERMLVDKLNYLVVDKKNLSNEPGGLYAAYQLTN |

TABLE 1-continued

Cas12 Protein Sequences

| SEQ ID NO | Description | Sequence |
|---|---|---|
| | | PLFSFEELHRYPQSGILFFVDPWNTSLTDPSTGFVNLLGRINYTNVGDARK FFDRFNAIRYDGKGNILFDLDLSRFDVRVETQRKLWTLTTFGSRIAKSKKS GKWMVERIENLSLCFLELFEQFNIGYRVEKDLKKAILSQDRKEFYVRLIYL FNLMMQIRNSDGEEDYILSPALNEKNLQFDSRLIEAKDLPVDADANGAYN VARKGLMVVQRIKRGDHESIHRIGRAQWLRYVQEGIVE |
| 149 | Moraxella bovoculi 237 (MbCas12a) | MLFQDFTHLYPLSKTVRFELKPIDRTLEHIHAKNFLSQDETMADMHQKVK VILDDYHRDFIADMMGEVKLTKLAEFYDVYLKFRKNPKDDELQKQLKDL QAVLRKEIVKPIGNGGKYKAGYDRLFGAKLFKDGKELGDLAKFVIAQEG ESSPKLAHLAHFEKFSTYFTGFHDNRKNMYSDEDKHTAIAYRLIHENLPRF IDNLQILTTIKQKHSALYDQIINELTASGLDVSLASHLDGYHKLLTQEGITA YNTLLGGISGEAGSPKIQGINELINSHHNQHCHKSERIAKLRPLHKQILSDG MSVSFLPSKFADDSEMCQAVNEFYRHYADVFAKVQSLFDGFDDHQKDGI YVEHKNLNELSKQAFGDFALLGRVLDGYYVDVVNPEFNERFAKAKTDN AKAKLTKEKDKFIKGVHSLASLEQAIEHYTARHDDESVQAGKLGQYFKH GLAGVDNPIQKIHNNHSTIKGFLERERPAGERALPKIKSGKNPEMTQLRQL KELLDNALNVAHFAKLLTTKTTLDNQDGNFYGEFGVLYDELAKIPTLYN KVRDYLSQKPFSTEKYKLNFGNPTLLNGWDLNKEKDNFGVILQKDGCYY LALLDKAHHKKVFDNAPNTGKSIYQKMIYKYLEVRKQFPKVFFSKEAIAIN YHPSKELVEIKDKGRQRSDDERLKLYRFILECLKIHPKYDKKFEGAIGDIQ LFKKDKKGREVPISEKDLFDKINGIFSSKPKLEMEDFFIGEFKRYNPSQDLV DQYNIYKKIDSNDNRKKENFYNNHPKFKKDLVRYYYESMCKHEEWEESF EFSKKLQDIGCYVDVNELFTEIETRRLNYKISFCNINADYIDELVEQGQLYL FQIYNKDFSPKAHGKPNLHTLYFKALFSEDNLADPIYKLNGEAQIFYRKAS LDMNETTIHRAGEVLENKNPDNPKKRQFVYDIIKDKRYTQDKFMLHVPIT MNFGVQGMTIKEFNKKVNQSIQQYDEVNVIGIDRGERHLLYLTVINSKGEI LEQCSLNDITTASANGTQMTTPYHKILDKREIERLNARVGWGEIETIKELK SGYLSHVVHQISQLMLKYNAIVVLEDLNFGFKRGRFKVEKQIYQNFENAL IKKLNHLVLKDKADDEIGSYKNALQLTNNFTDLKSIGKQTGFLFYVPAWN TSKIDPETGFVDLLKPRYENIAQSQAFFGKFDKICYNADKDYFEFHIDYAK FTDKAKNSRQIWTICSHGDKRYVYDKTANQNKGAAKGINVNDELKSLFA RHHINEKQPNLVMDICQNNDKEFHKSLMYLLKTLLALRYSNASSDEDFIL SPVANDEGVFFNSALADDTQPQNADANGAYHIALKGLWLLNELKNSDDL NKVKLAIDNQTWLNFAQNR |
| 150 | Moraxella bovoculi AAX08_00205 (Mb2Cas12a) | MGIHGVPAALFQDFTHLYPLSKTVRFELKPIGRTLEHIHAKNFLSQDETMA DMYQKVKVILDDYHRDFIADMMGEVKLTKLAEFYDVYLKFRKNPKDDG LQKQLKDLQAVLRKESVKPIGSGGKYKTGYDRLFGAKLFKDGKELGDLA KFVIAQEGESSPKLAHLAHFEKFSTYFTGFHDNRKNMYSDEDKHTAIAYR LIHENLPRFIDNLQILTTIKQKHSALYDQIINELTASGLDVSLASHLDGYHK LLTQEGITAYNRIIGEVNGYTNKHNQICHKSERIAKLRPLHKQILSDGMGV SFLPEGITAYNRIIGEVNGYTNKHNQICHKSERIAKLRPLHKQILSDGMGV SFLPSKFADDSEMCQAVNEFYRHYTDVFAKVQSLFDGFDDHQKDGIYVE HKNLNELSKQAFGDFALLGRVLDGYYVDVVNPEFNERFAKAKTDNAKA KLTKEKDKFIKGVHSLASLEQAIEHHTARHDDESVQAGKLGQYFKHGLA GVDNPIQKIHNNHSTIKGFLERERPAGERALPKIKSGKNPEMTQLRQLKEL LDNALNVAHFAKLLTTKTTLDNQDGNFYGEFGVLYDELAKIPTLYNKVR DYLSQKPFSTEKYKLNFGNPTLLNGWDLNKEKDNFGVILQKDGCYYLAL LDKAHKKVFDNAPNTGKNVYQKMVYKLLPGPNKMLPKVFFAKSNLDYY NPSAELLDKYAKGTHKKGDNFNLKDCHALIDFFKAGINKHPEWQHFGFK FSPTSSYRDLSDFYREVEPQGYQVKFVDINADYIDELVEQGKLYLFQIYNK DFSPKAHGKPNLHTLYFKALFSEDNLADPIYKLNGEAQIFYRKASLDMNE TTIHRAGEVLENKNPDNPKKRQFVYDIIKDKRYTQDKFMLHVPITMNFGV QGMTIKEFNKKVNQSIQQYDEVNVIGIDRGERHLLYLTVINSKGEILEQRS LNDITTASANGTQVTTPYHKILDKREIERLNARVGWGEIETIKELKSGYLS HVVHQINQLMLKYNAIVVLEDLNFGFKRGRFKVEKQIYQNFENALIKKLN HLVLKDKADDEIGSYKNALQLTNNFTDLKSIGKQTGFLFYVPAWNTSKID PETGFVDLLKPRYENIAQSQAFFGKFDKICYNTDKGYFEFHIDYAKFTDKA KNSRQKWAICSHGDKRYVYDKTANQNKGAAKGINVNDELKSLFARYHI NDKQPNLVMDICQNNDKEFHKSLMCLLKTLLALRYSNASSDEDFILSPVA NDEGVFFNSALADDTQPQNADANGAYHIALKGLWLLNELKNSDDLNKV KLAIDNQTWLNFAQNR |
| 151 | Moraxella bovoculi AAX11_00205 (Mb3Cas12a) | MGIHGVPAALFQDFTHLYPLSKTVRFELKPIGKTLEHIHAKNFLNQDETM ADMYQKVKAILDDYHRDFIADMMGEVKLTKLAEFYDVYLKFRKNPKDD GLQKQLKDLQAVLRKEIVKPIGNGGKYKAGYDRLFGAKLFKDGKELGDL AKFVIAQEGESSPKLAHLAHFEKFSTYFTGFHDNRKNMYSDEDKHTAIAY RLIHENLPRFIDNLQILATIKQKHSALYDQIINELTASGLDVSLASHLDGYH KLLTQEGITAYNTLLGGISGEAGSRKIQGINELINSHHNQHCHKSERIAKLR PLHKQILSDGMGVSFLPSKFADDSEVCQAVNEFYRHYADVFAKVQSLFD GFDDYQKDGIYVEYKNLNELSKQAFGDFALLGRVLDGYYVDVVNPEFNE RFAKAKTDNAKAKLTKEKDKFIKGVHSLASLEQAIEHYTARHDDESVQA GKLGQYFKHGLAGVDNPIQKIHNNHSTIKGFLERERPAGERALPKIKSDKS PEIRQLKELLDNALNVAHFAKLLTTKTTLHNQDGNFYGEFGALYDELAKI ATLYNKVRDYLSQKPFSTEKYKLNFGNPTLLNGWDLNKEKDNFGVILQK |

TABLE 1-continued

Cas12 Protein Sequences

| SEQ ID NO | Description | Sequence |
|---|---|---|
| | | DGCYYLALLDKAHKKVFDNAPNTGKSVYQKMIYKLLPGPNKMLPKVFF<br>AKSNLDYYNPSAELLDKYAQGTHKKGDNFNLKDCHALIDFFKAGINKHP<br>EWQHFGFKFSPTSSYQDLSDFYREVEPQGYQVKFVDINADYINELVEQGQ<br>LYLFQIYNKDFSPKAHGKPNLHTLYFKALFSEDNLVNPIYKLNGEAEIFYR<br>KASLDMNETTIHRAGEVLENKNPDNPKKRQFVYDIIKDKRYTQDKFMLH<br>VPITMNFGVQGMTIKEFNKKVNQSIQQYDEVNVIGIDRGERHLLYLTVINS<br>KGEILEQRSLNDITTASANGTQMTTPYHKILDKREIERLNARVGWGEIETI<br>KELKSGYLSHVVHQISQLMLKYNAIVVLEDLNFGFKRGRFKVEKQIYQNF<br>ENALIKKLNHLVLKDKADDEIGSYKNALQLTNNFTDLKSIGKQTGFLFYV<br>PAWNTSKIDPETGFVDLLKPRYENIAQSQAFFGKFDKICYNADRGYFEFHI<br>DYAKFNDKAKNSRQIWKICSHGDKRYVYDKTANQNKGATIGVNVNDEL<br>KSLFTRYHINDKQPNLVMDICQNNDKEFHKSLMYLLKTLLALRYSNASSD<br>EDFILSPVANDEGVFFNSALADDTQPQNADANGAYHIALKGLWLLNELK<br>NSDDLNKVKLAIDNQTWLNFAQNR |
| 152 | Thiomicro-<br>spira sp.<br>XS5<br>(TsCas12a) | MGIHGVPAATKTFDSEFFNLYSLQKTVRFELKPVGETASFVEDFKNEGLK<br>RVVSEDERRAVDYQKVKEIIDDYHRDFIEESLNYFPEQVSKDALEQAFHL<br>YQKLKAAKVEEREKALKEWEALQKKLREKVVKCFSDSNKARFSRIDKKE<br>LIKEDLINWLVAQNREDDIPTVETFNNFTTYFTGFHENRKNIYSKDDHATA<br>ISFRLIHENLPKFFDNVISFNKLKEGFPELKFDKVKEDLEVDYDLKHAFEIE<br>YFVNFVTQAGIDQYNYLLGGKTLEDGTKKQGMNEQINLFKQQQTRDKAR<br>QIPKLIPLFKQILSERTESQSFIPKQFESDQELFDSLQKLHNNCQDKFTVLQQ<br>AILGLAEADLKKVFIKTSDLNALSNTIFGNYSVFSDALNLYKESLKTKKAQ<br>EAFEKLPAHSIHDLIQYLEQFNSSLDAEKQQSTDTVLNYFIKTDELYSRFIK<br>STSEAFTQVQPLFELEALSSKRRPPESEDEGAKGQEGFEQIKRIKAYLDTL<br>MEAVHFAKPLYLVKGRKMIEGLDKDQSFYEAFEMAYQELESLIIPIYNKA<br>RSYLSRKPFKADKFKINFDNNTLLSGWDANKETANASILFKKDGLYYLGI<br>MPKGKTFLFDYFVSSEDSEKLKQRRQKTAEEEALAQDGESYFEKIRYKLLP<br>GASKMLPKVFFSNKNIGFYNPSDDILRIRNTASHTKNGTPQKGHSKVEFNL<br>NDCHKMIDFFKSSIQKHPEWGSFGFTFSDTSDFEDMSAFYREVENQGYVIS<br>FDKIKETYIQSQVEQGNLYLFQIYNKDFSPYSKGKPNLHTLYWKALFEEA<br>NLNNVVAKLNGEAEIFFRRHSIKASDKVVHPANQAIDNKNPHTEKTQSTF<br>EYDLVKDKRYTQDKFFFHVPISLNFKAQGVSKFNDKVNGFLKGNPDVNII<br>GIDRGERHLLYFTVVNQKGEILVQESLNTLMSDKGHVNDYQQKLDKKEQ<br>ERDAARKSWTTVENIKELKEGYLSHVVHKLAHLIIKYNAIVCLEDLNFGF<br>KRGRFKVEKQVYQKFEKALIDKLNYLVFKEKELGEVGHYLTAYQLTAPF<br>ESFKKLGKQSGILFYVPADYTSKIDPTTGFVNFLDLRYQSVEKAKQLLSDF<br>NAIRFNSVQNYFEFEIDYKKLTPKRKVGTQSKWVICTYGDVRYQNRRNQ<br>KGHWETEEVNVTEKLKALFASDSKTTTVIDYANDDNLIDVILEQDKASFF<br>KELLWLLKLTMTLRHSKIKSEDDFILSPVKNEQGEFYDSRKAGEVWPKDA<br>DANGAYHIALKGLWNLQQINQWEKGKTLNLAIKNQDWFSFIQEKPYQE |
| 153 | Butyrivibrio<br>sp. NC3005<br>(BsCas 12a) | MGIHGVPAAYYQNLTKKYPVSKTIRNELIPIGKTLENIRKNNILESDVKRK<br>QDYEHVKGIMDEYHKQLINEALDNYMLPSLNQAAEIYLKKHVDVEDREE<br>FKKTQDLLRREVTGRLKEHENYTKIGKKDILDLLEKLPSISEEDYNALESF<br>RNFYTYFTSYNKVRENLYSDEEKSSTVAYRLINENLPKFLDNIKSYAFVKA<br>AGVLADCIEEEEQDALFMVETFNMTLTQEGIDMYNYQIGKVNSAINLYNQ<br>KNHKVEEFKKIPKMKVLYKQILSDREEVFIGEFKDDETLLSSIGAYGNVL<br>MTYLKSEKINIFFDALRESEGKNVYVKNDLSKTTMSNIVFGSWSAFDELL<br>NQEYDLANENKKKDDKYFEKRQKELKKNKSYTLEQMSNLSKEDISPIEN<br>YIERISEDIEKICIYNGEFEKIVVNEHDSSRKLSKNIKAVKVIKDYLDSIKEL<br>EHDIKLINGSGQEELEKNLVVYVGQEEALEQLRPVDSLYNLTRNYLTKKPF<br>STEKVKLNFNKSTLLNGWDKNKETDNLGILFFKDGKYYLGIMNTTANKA<br>FVNPPAAKTENVFKKVDYKLLPGSNKMLPKVFFAKSNIGYYNPSTELYSN<br>YKKGTHKKGPSFSIDDCHNLIDFFKESIKKHEDWSKFGFEFSDTADYRDIS<br>EFYREVEKQGYKLTFTDIDESYINDLIEKNELYLFQIYNKDFSEYSKGKLN<br>LHTLYFMMLFDQRNLDNVVYKLNGEAEVFYRPASIAENELVIHKAGEGIK<br>NKNPNRAKVKETSTFSYDIVKDKRYSYKFTLHIPITMNFGVDEVRRFND<br>VINNALRTDDNVNVIGIDRGERNLLYVVVINSEGKILEQISLNSIINKEYDIE<br>TNYHALLDEREDDRNKARKDWNTIENIKELKTGYLSQVVNVVAKLVLKY<br>NAIICLEDLNFGFKRGRQKVEKQVYQKFEKMLIEKLNYLVIDKSREQVSPE<br>KMGGALNALQLTSKFKSFAELGKQSGITYYVPAYLTSKIDPTTGFVNLFYI<br>KYENIEKAKQFFDGFDFIRFNKKDDMFEFSFDYKSFTQKACGIRSKWIVYT<br>NGERIIKYPNPEKNNLFDEKVINVTDEIKGLFKQYRIPYENGEDIKEIISKA<br>EADFYKRLFRLLHQTLQMRNSTSDGTRDYIISPVKNDRGEFFCSEFSEGTM<br>PKDADANGAYNIARKGLWVLEQIRQKDEGEKVNLSMTNAEWLKYAQLH<br>LL |
| 154 | AacCas12b | MAVKSIKVKLRLDDMPEIRAGLWKLHKEVNAGVRYYTEWLSLLRQENL<br>YRRSPNGDGEQECDKTAEEECKAELLERLRARQVENGHRGPAGSDDELLQ<br>LARQLYELLVPQAIGAKGDAQQIARKFLSPLADKDAVGGLGIAKAGNKP<br>RWVRMREAGEPGWEEEKEKAETRKSADRTADVLRALADFGLKPLMRVY<br>TDSEMSSVEWKPLRKGQAVRTWDRDMFQQAIERMMSWESWNQRVGQE<br>YAKLVEQKNRFEQKNFVGQEHLVHLVNQLQQDMKEASPGLESKEQTAH |

TABLE 1-continued

Cas12 Protein Sequences

| SEQ ID NO | Description | Sequence |
|---|---|---|
| | | YVTGRALRGSDKVFEKWGKLAPDAPFDLYDAEIKNVQRRNTRRFGSHDL<br>FAKLAEPEYQALWREDASFLTRYAVYNSILRKLNHAKMFATFTLPDATA<br>HPIWTRFDKLGGNLHQYTFLFNEFGERRHAIRFHKLLKVENGVAREVDD<br>VTVPISMSEQLDNLLPRDPNEPIALYFRDYGAEQHFTGEFGGAKIQCRRDQ<br>LAHMHRRRGARDVYLNVSVRVQSQSEARGERRPPYAAVFRLVGDNHRA<br>FVHFDKLSDYLAEHPDDGKLGSEGLLSGLRVMSVDLGLRTSASISVFRVA<br>RKDELKPNSKGRVPFFFPIKGNDNLVAVHERSQLLKLPGETESKDLRAIRE<br>ERQRTLRQLRTQLAYLRLLVRCGSEDVGRRERSWAKLIEQPVDAANHMT<br>PDWREAFENELQKLKSLHGICSDKEWMDAVYESVRRVWRHMGKQVRD<br>WRKDVRSGERPKIRGYAKDVVGGNSIEQIEYLERQYKFLKSWSFFGKVSG<br>QVIRAEKGSRFAITLREHIDHAKEDRLKKLADRIIMEALGYVYALDERGK<br>GKWVAKYPPCQLILLEELSEYQFNNDRPPSENNQLMQWSHRGVFQELIN<br>QAQVHDLLVGTMYAAFSSRFDARTGAPGIRCRRVPARCTQEHNPEPFPW<br>WLNKFVVEHTLDACPLRADDLIPTGEGEIFVSPFSAEEGDFHQIHADLNAA<br>QNLQQRLWSDFDISQIRLRCDWGEVDGELVLIPRLTGKRTADSYSNKVFY<br>TNTGVTYYERERGKKRRKVFAQEKLSEEEAELLVEADEAREKSVVLMRD<br>PSGIINRGNWTRQKEFWSMVNQRIEGYLVKQIRSRVPLQDSACENTGDI |
| 155 | Variant | MKKIDNFVGCYPVSKTLRFKAIPIGKTQENIEKKRLVEEDEVRAKD<br>YKAVKKLIDRYHREFIEGVLDNVKLDGLEEYYMLFNKSDREESDN<br>KKIEIMEERFRRVISKSFKNNEEYKKIFSKKIIEEILPNYIKDEEEKEL<br>VKGFKGFYTAFVGYAQNRENMYSDEKKSTAISYRIVNENMPRFITN<br>IKVFEKAKSILDVDKINEINEYILNNDYYVDDFFNIDFFNYVLNQKGI<br>DIYNAIIGGIVTGDGRKIQGLNECINLYNQENKKIRLPQFKPLYKQIL<br>SESESMSFYIDEIESDDMLIDMLKESLQIDSTINNAIDDLKVLFNNIFD<br>YDLSGIFINNGLPITTISNDVYGQWSTISDGWNERYDVLSNAKDKES<br>EKYFEKRRKEYKKVKSFSISDLQELGGKDLSICKKINEIISEMIDDYK<br>SKIEEIQYLFDIKELEKPLVTDLNKIELIKNSLDGLKRIERYVIPFLGT<br>GKEQNRDEVFYGYFIKCIDAIKEIDGVYNKTRNYLTKKPYSKDKFK<br>LYFENPQLMGGWDRNKESDYRSTLLRKNGKYYVAIIDKSSSNCMM<br>NIEEDENDNYEKINYKLLPGPNKMLPKVFFSKKNREYFAPSKEIERI<br>YSTGTFKKDTNFVKKDCENLITFYKDSLDRHEDWSKSFDFSFKESS<br>AYRDISEFYRDVEKQGYRVSFDLLSSNAVNTLVEEGKLYLFQLYNK<br>DFSEKSHGIPNLHTMYFRSLFDDNNKGNIRLNGGAEMFMRRASLN<br>KQDVTVHKANQPIKNKNLLNPKKTTTLPYDVYKDKRFTEDQYEVH<br>IPITMNKVPNNPYKINHMVREQLVKDDNPYVIGIDRGERNLIYVVV<br>VDGQGHIVEQLSLNEIINENNGISIRTDYHTLLDAKERERDESRKQW<br>KQIENIKELKEGYISQVVHKICELVEKYDAVIALEDLNSGFKNSRVK<br>VEKQVYQKFEKMLITKLNYMVDKKKDYNKPGGVLNGYQLTTQFE<br>SFSKMGTQNGIMFYIPAWLTSKMDPTTGFVDLLKPKYKNKADAQK<br>FFSQFDSIRYDNQEDAFVFKVNYTKFPRTDADYNKEWEIYTNGERI<br>RVFRNPKKNNEYDYETVNVSERMKELFDSYDLLYDKGELKETICE<br>MEESKFFEELIKLFRLTLQMRNSISGRTDVDYLISPVKNSNGYFYNS<br>NDYKKEGAKYPKDADANGAYNIARKVLWAIEQFKMADEDKLDK<br>TKISIKNQEWLEYAQTHCE |

Alternatively, the Type V CRISPR/Cas enzyme is a programmable Cas14 nuclease. A Cas14 protein of the present disclosure includes 3 partial RuvC domains (RuvC-I, RuvC-II, and RuvC-III, also referred to herein as subdomains) that are not contiguous with respect to the primary amino acid sequence of the Cas14 protein, but form a RuvC domain once the protein is produced and folds. A naturally occurring Cas14 protein functions as an endonuclease that catalyzes cleavage at a specific sequence in a target nucleic acid. A programmable Cas14 nuclease can be a Cas14a protein, a Cas14b protein, a Cas14c protein, a Cas14d protein, a Cas14e protein, a Cas14f protein, a Cas14g protein, a Cas14h protein, or a Cas14u protein. In some cases, a suitable Cas14 protein comprises an amino acid sequence having at least 80%, at least 85%, at least 90%, at least 95%, at least 98%, at least 99%, or 100%, amino acid sequence identity to any one of SEQ ID NO: 53-SEQ ID NO: 144.

TABLE 2

Cas14 Protein Sequences

| SEQ ID NO | Sequence |
|---|---|
| 53 | MEVQKTVMKTLSLRILRPLYSQEIEKEIKEEKERRKQAGGTGELDGGFYKKLEKKHSEM<br>FSFDRLNLLLNQLQREIAKVYNHAISELYIATIAQGNKSNKHYISSIVYNRAYGYFYNAYI<br>ALGICSKVEANFRSNELLTQQSALPTAKSDNFPIVLHKQKGAEGEDGGFRISTEGSDLIFEI<br>PIPFYEYNGENRKEPYKWVKKGGQKPVLKLILSTFRRQRNKGWAKDEGTDAEIRKVTEG<br>KYQVSQIEINRGKKLGEHQKWFANFSIEQPIYERKPNRSIVGGLDVGIRSPLVCAINNSFSR<br>YSVDSNDVFKFSKQVFAFRRRLLSKNSLKRKGHGAAHKLEPITEMTEKNDKFRKKIIER |

TABLE 2-continued

Cas14 Protein Sequences

| SEQ ID NO | Sequence |
|---|---|
| | WAKEVTNFFVKNQVGIVQIEDLSTMKDREDHFFNQYLRGFWPYYQMQTLIENKLKEYG<br>IEVKRVQAKYTSQLCSNPNCRYWNNYFNFEYRKVNKFPKFKCEKCNLEISADYNAARN<br>LSTPDIEKFVAKATKGINLPEK |
| 54 | MEEAKTVSKTLSLRILRPLYSAEIEKEIKEEKERRKQGGKSGELDSGFYKKLEKKHTQMF<br>GWDKLNLMLSQLQRQIARVFNQSISELYIETVIQGKKSNKHYTSKIVYNRAYSVFYNAYL<br>ALGITSKVEANFRSTELLMQKSSLPTAKSDNFPILLHKQKGVEGEEGGFKISADGNDLIFEI<br>PIPFYEYDSANKKEPFKWIKKGGQKPTIKLILSTFRRQRNKGWAKDEGTDAEIRKVIEGK<br>YQVSHIEINRGKKLGDHQKWFVNFTIEQPIYERKLDKNIIGGIDVGIKSPLVCAVNNSFAR<br>YSVDSNDVLKFSKQAFAFRRRLLSKNSLKRSGHGSKNKLDPITRMTEKNDRFRKKIIERW<br>AKEVTNFFIKNQVGTVQIEDLSTMKDRQDNFFNQYLRGFWPYYQMQNLIENKLKEYGIE<br>TKRIKARYTSQLCSNPSCRHWNSYSFSFDHRKTNNFPKFKCEKCALEISADYNAARNISTP<br>DIEKFVAKATKGINLPDKNENVILE |
| 55 | MAKNTITKTLKLRIVRPYNSAEVEKIVADEKNNREKIALEKNKDKVKEACSKHLKVAAY<br>CTTQVERNACLFCKARKLDDKFYQKLRGQFPDAVFWQEISEIFRQLQKQAAEIYNQSLIE<br>LYYEIFIKGKGIANASSVEHYLSDVCYTRAAELFKNAAIASGLRSKIKSNFRLKELKNMKS<br>GLPTTKSDNFPIPLVKQKGGQYTGFEISNHNSDFIIKIPFGRWQVKKEIDKYRPWEKFDFE<br>QVQKSPKPISLLLSTQRRKRNKGWSKDEGTEAEIKKVMNGDYQTSYIEVKRGSKIGEKS<br>AWMLNLSIDVPKIDKGVDPSIIGGIDVGKSPLVCAINNAFSRYSISDNDLFHFNKKMFAR<br>RRILLKKNRHKRAGHGAKNKLKPITILTEKSERFRKKLIERWACEIADFFIKNKVGTVQM<br>ENLESMKRKEDSYFNIRLRGFWPYAEMQNKIEFKLKQYGIEIRKVAPNNTSKTCSKCGHL<br>NNYFNFEYRKKNKFPHFKCEKCNFKENADYNAALNISNPKLKSTKEEP |
| 56 | MERQKVPQIRKIVRVVPLRILRPKYSDVIENALKKFKEKGDDTNTNDFWRAIRDRDTEFF<br>RKELNFSEDEINQLERDTLFRVGLDNRVLFSYFDFLQEKLMKDYNKIISKLFINRQSKSSF<br>ENDLTDEEVEELIEKDVTPFYGAYIGKGIKSVIKSNLGGKFIKSVKIDRETKKVTKLTAINI<br>GLMGLPVAKSDTFPIKIIKTNPDYITFQKSTKENLQKIEDYETGIEYGDLLVQITIPWFKNE<br>NKDFSLIKTKEAIEYYKLNGVGKKDLLNINLVLTTYHIRKKKSWQIDGSSQSLVREMAN<br>GELEEKWKSFFDTFIKKYGDEGKSALVKRRVNKKSRAKGEKGRELNLDERIKRLYDSIK<br>AKSFPSEINLIPENYKWKLHFSIEIPPMVNDIDSNLYGGIDPGEQNIATLCVKNIEKDDYDF<br>LTIYGNDLLKHAQASYARRRIMRVQDEYKARGHGKSRKTKAQEDYSERMQKLRQKITE<br>RLVKQISDFFLWRNKFHMAVCSLRYEDLNTLYKGESVKAKRMRQFINKQQLFNGIERKL<br>KDYNSEIYVNSRYPHYTSRLCSKCGKLNLYFDFLKFRTKNIIIRKNPDGSEIKYMPFFICEF<br>CGWKQAGDKNASANIADKDYQDKLNKEKEFCNIRKPKSKKEDIGEENEEERDYSRRFN<br>RNSFIYNSLKKDNKLNQEKLFDEWKNQLKRKIDGRNKFEPKEYKDRFSYLFAYYQEIIKN<br>ESES |
| 57 | MVPTELITKTLQLRVIRPLYFEEIEKELAELKEQKEKEFEETNSLLLESKKIDAKSLKKLKR<br>KARSSSAAVEFWKIAKEKYPDILTKPEMEFIFSEMQKMMARFYNKSMTNIFIEMNNDEKV<br>NPLSLISKASTEANQVIKCSSISSGLNRKIAGSINKTKFKQVRDGLISLPTARTETFPISFYKS<br>TANKDEIPISKINLPSEEEADLTITLPFPFFEIKKEKKGQKAYSYFNIIEKSGRSNNKIDLLLS<br>THRRQRRKGWKEEGGTSAEIRRLMEGEFDKEWEIYLGEAEKSEKAKNDLIKNMTRGKL<br>SKDIKEQLEDIQVKYFSDNNVESWNDLSKEQKQELSKLRKKKVEELKDWKHVKEILKTR<br>AKIGWVELKRGKRQRDRNKWFVNITITRPPFINKELDDTKFGGIDLGVKVPFVCAVHGSP<br>ARLIIKENEILQFNKMVSARNRQITKDSEQRKGRGKKNKFIKKEIFNERNELFRKKIIERW<br>ANQIVKFFEDQKCATVQIENLESFDRTSYK |
| 58 | MKSDTKDKKIIIHQTKTLSLRIVKPQSIPMEEFTDLVRYHQMIIFPVYNNGAIDLYKKLFK<br>AKIQKGNEARAIKYFMNKIVYAPIANTVKNSYIALGYSTKMQSSFSGKRLWDLRFGEAT<br>PPTIKADFPLPFYNQSGFKVSSENGEFIIGIPFGQYTKKTVSDIEKKTSFAWDKFTLEDTTK<br>KTLIELLLSTKTRKMNEGWKNNEGTEAEIKRVMDGTYQVTSIEILQRDDSWFVNFNIAY<br>DSLKKQPDRDKIAGIHMGITRPLTAVIYNNKYRALSIYPNTVMHLTQKQLARIKEQRTNS<br>KYATGGHGRNAKVTGTDTLSEAYRQRRKKIIEDWIASIVKFAINNEIGTIYLEDISNTNSFF<br>AAREQKLIYLEDISNTNSFLSTYKYPISAISDTLQHKLEEKAIQVIRKKAYYVNQICSLCGH<br>YNKGFTYQFRRKNKFPKMKCQGCLEATSTEFNAAANVANPDYEKLLIKHGLLQLKK |
| 59 | MSTITRQVRLSPTPEQSRLLMAHCQQYISTVNVLVAAFDSEVLTGKVSTKDFRAALPSAV<br>KNQALRDAQSVFKRSVELGCLPVLKKPHCQWNNQNWRVEGDQLILPICKDGKTQQERF<br>RCAAVALEGKAGILRIKKKRGKWIADLTVTQEDAPESSGSAIMGVDLGIKVPAVAHIGG<br>KGTRFFGNGRSQRSMRRRFYARRKTLQKAKKLRAVRKSKGKEARWMKTINHQLSRQIV<br>NHAHALGVGTIKIEALQGIRKGTTRKSRGAAARKNNRMTNTWSFSQLTLFITYKAQRQG<br>ITVEQVDPAYTSQDCPACRARNGAQDRTYVCSECGWRGHRDTVGAINISRRAGLSGHRR<br>GATGA |
| 60 | MIAQKTIKIKLNPTKEQIIKLNSIIEEYIKVSNFTAKKIAEIQESFTDSGLTQGTCSECGKEKT<br>YRKYHLLKKDNKLFCITCYKRKYSQFTLQKVEFQNKTGLRNVAKLPKTYYTNAIRFASD<br>TFSGFDEIIKKKQNRLNSIQNRLNFWKELLYNPSNREIKIKVVKYAPKTDTREHPHYYSE<br>AEIKGRIKRLEKQLKKFKMPKYPEFTSETISLQRELYSWKNPDELKISSITDKNESMNYYG<br>KEYLKRYIDLINSQTPQILLEKENNSFYLCFPITKNIEMPKIDDTFEPVGIDWGITRNIAVVS<br>ILDSKTKKPKFVKFYSAGYILGKRKHYKSLRKHFGQKKRQDKINKLGTKEDRFIDSNIHK<br>LAFLIVKEIRNHSNKPIILMENITDNREEAEKSMRQNILLHSVKSRLQNYIAYKALWNNIP<br>TNLVKPEHTSQICNRCGHQDRENRPKGSKLFKCVKCNYMSNADFNASINIARKFYIGEYE<br>PFYKDNEKMKSGVNSISM |

TABLE 2-continued

Cas14 Protein Sequences

SEQ
ID
NO  Sequence

61  LKLSEQENITTGVKFKLKLDKETSEGLNDYFDEYGKAINFAIKVIQKELAEDRFAGKVRL
    DENKKPLLNEDGKKIWDFPNEFCSCGKQVNRYVNGKSLCQECYKNKFTEYGIRKRMYS
    AKGRKAEQDINIKNSTNKISKTHFNYAIREAFILDKSIKKQRKERFRRLREMKKKLQEFIEI
    RDGNKILCPKIEKQRVERYIHPSWINKEKKLEDFRGYSMSNVLGKIKILDRNIKREEKSLK
    EKGQINFKARRLMLDKSVKFLNDNKISFTISKNLPKEYELDLPEKEKRLNWLKEKIKIIKN
    QKPKYAYLLRKDDNFYLQYTLETEFNLKEDYSGIVGIDRGVSHIAVYTFVHNNGKNERP
    LFLNSSEILRLKNLQKERDRFLRRKHNKKRKKSNMRNIEKKIQLILIHNYSKQIVDFAKNK
    NAFIVFEKLEKPKKNRSKMSKKSQYKLSQFTFKKLSDLVDYKAKREGIKVLYISPEYTSK
    ECSHCGEKVNTQRPFNGNSSLFKCNKCGVELNADYNASINIAKKGLNILNSTN

62  MEESIITGVKFKLRIDKETTKKLNEYFDEYGKAINFAVKIIQKELADDRFAGKAKLDQNK
    NPILDENGKKIYEFPDEFCSCGKQVNKYVNNKPFCQECYKIRFTENGIRKRMYSAKGRK
    AEHKINILNSTNKISKTHFNYAIREAFILDKSIKKQRKKRNERLRESKKRLQQFIDMRDGK
    REICPTIKGQKVDRFIHPSWITKDKKLEDFRGYTLSIINSKIKILDRNIKREEKSLKEKGQIIF
    KAKRLMLDKSIRFVGDRKVLFTISKTLPKEYELDLPSKEKRLNWLKEKIEIIKNQKPKYA
    YLLRKNIESEKKPNYEYYLQYTLEIKPELKDFYDGAIGIDRGINHIAVCTFISNDGKVTPPK
    FFSSGEILRLKNLQKERDRFLLRKHNKNRKKGNMRVIENKINLILHRYSKQIVDMAKKLN
    ASIVFEELGRIGKSRTKMKKSQRYKLSLFIFKKLSDLVDYKSRREGIRVTYVPPEYTSKEC
    SHCGEKVNTQRPFNGNYSLFKCNKCGIQLNSDYNASINIAKKGLKIPNST

63  LWTIVIGDFIEMPKQDLVTTGIKFKLDVDKETRKKLDDYFDEYGKAINFAVKIIQKNLKE
    DRFAGKIALGEDKKPLLDKDGKKIYNYPNESCSCGNQVRRYVNAKPFCVDCYKLKFTE
    NGIRKRMYSARGRKADSDINIKNSTNKISKTHFNYAIREGFILDKSLKKQRSKRIKKLLEL
    KRKLQEFIDIRQGQMVLCPKIKNQRVDKFIHPSWLKRDKKLEEFRGYSLSVVEGKIKIFN
    RNILREEDSLRQRGHVNFKANRIMLDKSVRFLDGGKVNFNLNKGLPKEYLLDLPKKENK
    LSWLNEKISLIKLQKPKYAYLLRREGSFFIQYTIENVPKTFSDYLGAIGIDRGISHIAVCTFV
    SKNGVNKAPVFFSSGEILKLKSLQKQRDLFLRGKHNKIRKKSNMRNIDNKINLILHKYSR
    NIVNLAKSEKAFIVFEKLEKIKKSRFKMSKSLQYKLSQFTFKKLSDLVEYKAKIEGIKVDY
    VPPEYTSKECSHCGEKVDTQRPFNGNSSLFKCNKCRVQLNADYNASINIAKKSLNISN

64  MSKTTISVKLKIIDLSSEKKEFLDNYFNEYAKATTFCQLRIRRLLRNTHWLGKKEKSSKK
    WIFESGICDLCGENKELVNEDRNSGEPAKICKRCYNGRYGNQMIRKLFVSTKKREVQEN
    MDIRRVAKLNNTHYHRIPEEAFDMIKAADTAEKRRKKNVEYDKKRQMEFIEMFNDEKK
    RAARPKKPNERETRYVHISKLESPSKGYTLNGIKRKIDGMGKKIERAEKGLSRKKIFGYQ
    GNRIKLDSNWVRFDLAESEITIPSLFKEMKLRITGPTNVHSKSGQIYFAEWFERINKQPNN
    YCYLIRKTSSNGKYEYYLQYTYEAEVEANKEYAGCLGVDIGCSKLAAAVYYDSKNKKA
    QKPIEIFTNPIKKIKMRREKLIKLLSRVKVRHRRRKLMQLSKTEPIIDYTCHKTARKIVEM
    ANTAKAFISMENLETGIKQKQQARETKKQKFYRNMFLFRKLSKLIEYKALLKGIKIVYVK
    PDYTSQTCSSCGADKEKTERPSQAIFRCLNPTCRYYQRDINADFNAAVNIAKKALNNTEV
    VTTLL

65  MARAKNQPYQKLTTTTGIKFKLDLSEEEGKRFDEYFSEYAKAVNFCAKVIYQLRKNLKF
    AGKKELAAKEWKFEISNCDFCNKQKEIYYKNIANGQKVCKGCHRTNFSDNAIRKKMIPV
    KGRKVESKFNIHNTTKKISGTHRHWAFEDAADIIESMDKQREKQKRLRREKRKLSYFF
    ELFGDPAKRYELPKVGKQRVPRYLHKIIDKSLTKKRGYSLSYIKNKIKISERNIERDEKS
    LRKASPIAFGARKIKMSKLDPKRAFDLENNVFKIPGKVIKGQYKFFGTNVANEHGKKFY
    KDRISKILAGKPKYFYLLRKKVAESDGNPIFEYYVQWSIDTETPAITSYDNILGIDAGITNL
    ATTVLIPKNLSAEHCSHCGNNHVKPIFTKFFSGKELKAIKIKSRKQKYFLRGKHNKLVKIK
    RIRPIEQKVDGYCHVVSKQIVEMAKERNSCIALEKLEKPKKSKFRQRRREKYAVSMFVF
    KKLATFIKYKAAREGIEIIPVEPEGTSYTCSHCKNAQNNQRPYFKPNSKKSWTSMFKCGK
    CGIELNSDYNAAFNIAQKALNMTSA

66  MDEKHFFCSYCNKELKISKNLINKISKGSIREDEAVSKAISIHNKKEHSLILGIKFKLFIENK
    LDKKKLNEYFDNYSKAVTFAARIFDKIRSPYKFIGLKDKNTKKWTFPKAKCVFCLEEKE
    VAYANEKDNSKICTECYLKEFGENGIRKKIYSTRGRKVEPKYNIFNSTKELSSTHYNYAIR
    DAFQLLDALKKQRQKKLKSIFNQKLRLKEFEDIFSDPQKRIELSLKPHQREKRYIHLSKSG
    QESINRGYTLRFVRGKIKSLTRNIEREEKSLRKKTPIHFKGNRLMIFPAGIKFDFASNKVKI
    SISKNLPNEFNFSGTNVKNEHGKSFFKSRIELIKTQKPKYAYVLRKIKREYSKLRNYEIEKI
    RLENPNADLCDFYLQYTIETESRNNEEINGIIGIDRGITNLACLVLLKKGDKKPSGVKFYK
    GNKILGMKIAYRKHLYLLKGKRNKLRKQRQIRAIEPKINLILHQISKDIVKIAKEKNFAIAL
    EQLEKPKKARFAQRKKEKYKLALFTFKNLSTLIEYKSKREGIPVIYVPPEKTSQMCSHCAI
    NGDEHVDTQRPYKKPNAQKPSYSLFKCNKCGIELNADYNAAFNIAQKGLKTLMLNHSH

67  MLQTLLVKLDPSKEQYKMLYETMERFNEACNQIAETVFAIHSANKIEVQKTVYYPIREKF
    GLSAQLTILAIRKVCEAYKRDKSIKPEFRLDGALVYDQRVLSWKGLDKVSLVTLQGRQII
    PIKFGDYQKARMDRIRGQADLILVKGVFYLCVVVEVSEESPYDPKGVLGVDLGIKNLAV
    DSDGEVHSGEQTTNTRERLDSLKARLQSKGTKSAKRHLKKLSGRMAKFSKDVNHCISK
    KLVAKAKGTLMSIALEDLQGIRDRVTVRKAQRRNLHTWNFGLLRMFVDYKAKIAGVPL
    VFVDPRNTSRTCPSCGHVAKANRPTRDEFRCVSCGFAGAADHIAAMNIAFRAEVSQPIVT
    RFFVQSQAPSFRVG

TABLE 2-continued

Cas14 Protein Sequences

| SEQ ID NO | Sequence |
|---|---|
| 68 | MDEEPDSAEPNLAPISVKLKLVKLDGEKLAALNDYFNEYAKAVNFCELKMQKIRKNLV NIRGTYLKEKKAWINQTGECCICKKIDELRCEDKNPDINGKICKKCYNGRYGNQMIRKLF VSTNKRAVPKSLDIRKVARLHNTHYHRIPPEAADIIKAIETAERKRRNRILFDERRYNELK DALENEEKRVARPKKPKEREVRYVPISKKDTPSKGYTMNALVRKVSGMAKKIERAKRN LNKRKKIEYLGRRILLDKNWVRFDFDKSEISIPTMKEFFGEMRFEITGPSNVMSPNGREYF TKWFDRIKAQPDNYCYLLRKESEDETDFYLQYTWRPDAHPKKDYTGCLGIDIGGSKLAS AVYFDADKNRAKQPIQIFSNPIGKWKTKRQKVIKVLSKAAVRHKTKKLESLRNIEPRIDV HCHRIARKIVGMALAANAFISMENLEGGIREKQKAKETKKQKFSRNMFVFRKLSKLIEY KALMEGVKVVYIVPDYTSQLCSSCGTNNTKRPKQAIFMCQNTECRYFGKNINADFNAAI NIAKKALNRKDIVRELS |
| 69 | MEKNNSEQTSITTGIKFKLKLDKETKEKLNNYFDEYGKAINFAVRIIQMQLNDDRLAGK YKRDEKGKPILGEDGKKILEIPNDFCSCGNQVNHYVNGVSFCQECYKKRFSENGIRKRM YSAKGRKAEQDINIKNSTNKISKTHFNYAIREAFNLDKSIKKQREKRFKKLKDMKRKLQE FLEIRDGKRVICPKIEKQKVERYIHPSWINKEKKLEEFRGYSLSIVNSKIKSFDRNIQREEKS LKEKGQINFKAQRLMLDKSVKFLKDNKVSFTISKELPKTFELDLPKKEKKLNWLNEKLEI IKNQKPKYAYLLRKENNIFLQYTLDSIPEIHSEYSGAVGIDRGVSHIAVYTFLDKDGKNER PFFLSSSGILRLKNLQKERDKFLRKKHNKIRKKGNMRNIEQKINLILHEYSKQIVNFAKDK NAFIVFELLEKPKKSRERMSKKIQYKLSQFTFKKLSDLVDYKAKREGIKVIYVEPAYTSK DCSHCGERVNTQRPFNGNFSLFKCNKCGIVLNSDYNASLNIARKGLNISAN |
| 70 | MAEEKFFFCEKCNKDIKIPKNYINKQGAEEKARAKHEHRVHALILGIKFKIYPKKEDISKL NDYFDEYAKAVTFTAKIVDKLKAPFLFAGKRDKDTSKKKWVFPVDKCSFCKEKTEINYR TKQGKNICNSCYLTEFGEQGLLEKIYATKGRKVSSSFNLFNSTKKLTGTHNNYVVKESLQ LLDALKKQRSKRLKKLSNTRRKLKQFEEMFEKEDKRFQLPLKEKQRELRFIHVSQKDRA TEFKGYTMNKIKSKIKVLRRNIEREQRSLNRKSPVFFRGTRIRLSPSVQFDDKDNKIKLTL SKELPKEYSFSGLNVANEHGRKFFAEKLKLIKENKSKYAYLLRRQVNKNNKKPIYDYYL QYTVEFLPNIITNYNGILGIDRGINTLACIVLLENKKEKPSFVKFFSGKGILNLKNKRRKQL YFLKGVHNKYRKQQKIRPIEPRIDQILHDISKQIIDLAKEKRVAISLEQLEKPQKPKFRQSR KAKYKLSQFNFKTLSNYIDYKAKKEGIRVIYIAPEMTSQNCSRCAMKNDLHVNTQRPYK NTSSLFKCNKCGVELNADYNAAFNIAQKGLKILNS |
| 71 | MISLKLKLLPDEEQKKLLDEMFWKWASICTRVGFGRADKEDLKPPKDAEGVWFSLTQL NQANTDINDLREAMKHQKHRLEYEKNRLEAQRDDTQDALKNPDRREISTKRKDLFRPK ASVEKGFLKLKYHQERYWVRRLKEINKLIERKTKTLIKIEKGRIKFKATRITLHQGSFKIR FGDKPAFLIKALSGKNQIDAPFVVVPEQPICGSVVNSKKYLDEITTNFLAYSVNAMLFGLS RSEEMLLKAKRPEKIKKKEEKLAKKQSAFENKKKELQKLLGRELTQQEEAIIEETRNQFF QDFEVKITKQYSELLSKIANELKQKNDFLKVNKYPILLRKPLKKAKSKKINNLSPSEWKY YLQFGVKPLLKQKSRRKSRNVLGIDRGLKHLLAVTVLEPDKKTFVWNKLYPNPITGWK WRRRKLLRSLKRLKRRIKSQKHETIHENQTRKKLKSLQGRIDDLLHNISRKIVETAKEYD AVIVVEDLQSMRQHGRSKGNRLKTLNYALSLFDYANVMQLIKYKAGIEGIQIYDVKPAG TSQNCAYCLLAQRDSHEYKRSQENSKIGVCLNPNCQNHKKQIDADLNAARVIASCYALK INDSQPFGTRKRFKKRTTN |
| 72 | METLSLKLKLNPSKEQLLVLDKMFWKWASICTRLGLKKAEMSDLEPPKDAEGVWFSKT QLNQANTDVNDLRKAMQHQGKRIEYELDKVENRRNEIQEMLEKPDRRDISPNRKDLFRP KAAVEKGYLKLKYHKLGYWSKELKTANKLIERKRKTLAKIDAGKMKFKPTRISLHTNSF RIKFGEEPKIALSTTSKHEKIELPLITSLQRPLKTSCAKKSKTYLDAAILNFLAYSTNAALF GLSRSEEMLLKAKKPEKIEKRDRKLATKRESFDKKLKTLEKLLERKLSEKEKSVFKRKQT EFFDKFCITLDETYVEALHRIAEELVSKNKYLEIKKYPVLLRKPESRLRSKKLKNLKPED WTYYIQFGFQPLLDTPKPIKTKTVLGIDRGVRHLLAVSIFDPRTKTFTFNRLYSNPIVDWK WRRRKKLLRSIKRLKRRLKSEKHVHLHENQFKAKLRSLEGRIEDHFHNLSKEIVDLAKEN NSVIVVENLGGMRQHGRGRGKWLKALNYALSHFDYAKVMQLIKYKAELAGVFVYDV APAGTSINCAYCLLNDKDASNYTRGKVINGKKNTKIGECKTCKKEFDADLNAARVIALC YEKRLNDPQPFGTRKQFKPKKP |
| 73 | MKALKLQLIPTRKQYKILDEMFWKWASLANRVSQKGESKETLAPKKDIQKIQFNATQLN QIEKDIKDLRGAMKEQQKQKERLLLQIQERRSTISEMLNDDNNKERDPHRPLNFRPKGW RKFHTSKHWVGELSKILRQEDRVKKTIERIVAGKISFKPKRIGIWSSNYKINFFKRKISINP LNSKGFELTLMTEPTQDLIGKNGGKSVLNNKRYLDDSIKSLLMFALHSRFFGLNNTDTYL LGGKINPSLVKYYKKNQDMGEFGREIVEKFERKLKQEINEQQKKIIMSQIKEQYSNRDSA FNKDYLGLINEFSEVFNQRKSERAEYLLDSFEDKIKQIKQEIGESLNISDWDFLIDEAKKA YGYEEGFTEYVVYSKRYLEILNKIVKAVLITDIYFDLRKYPILLRKPLDKIKKISNLKPDEWS YYIQFGYDSINPVQLMSTDKFLGIDRGLTHLLAYSVFDKEKKEFIINQLEPNPIMGWKWK LRKVKRSLQHLERRIRAQKMVKLPENQMKKKLKSIEPKIEVHYHNISRKIVNLAKDYNA SIVVVESLEGGGLKQHGRKKNARNRSLNYALSLFDYGKIASLIKYKADLEGVPMYEVLPA YTSQQCAKCVLEKGSFVDPEIIGYVEDIGIKGSLLDSLFEGTELSSIQVLKKIKNKIELSAR DNHNKEINLILKYNFKGLVIVRGQDKEEIAEHPIKEINGKFAILDFVYKRGKEKVGKKGN QKVRYTGNKKVGYCSKHGQVDADLNASRVIALCKYLDINDPILFGEQRKSFK |
| 74 | MVTRAIKLKLDPTKNQYKLLNEMFWKWASLANRFSQKGASKETLAPKDGTQKIQFNAT QLNQIKKDVDDLRGAMEKQGKQKERLLIQIQERLLTISEILRDDSKKEKDPHRPQNFRPF GWRRFHTSAYWSSEASKLTRQVDRVRRTIERIKAGKINFKPKRIGLWSSTYKINFLKKKI NISPLKSKSFELDLITEPQQKIIGKEGGKSVANSKKYLDDSIKSLLIFAIKSRLFGLNNKDKP |

TABLE 2-continued

Cas14 Protein Sequences

| SEQ ID NO | Sequence |
|---|---|
| | LFENIITPNLVRYHKKGQEQENFKKEVIKKFENKLKKEISQKQKEIIFSQIERQYENRDATF<br>SEDYLRAISEFSEIFNQRKKERAKELLNSFNEKIRQLKKEVNGNISEEDLKILEVEAEKAY<br>NYENGFIEWEYSEQFLGVLEKIARAVLISDNYFDLKKYPILIRKPTNKSKKITNLKPEEWD<br>YYIQFGYGLINSPMKIETKNFMGIDRGLTHLLAYSIFDRDSEKFTINQLELNPIKGWKWKL<br>RKVKRSLQHLERRMRAQKGVKLPENQMKKRLKSIEPKIESYYHNLSRKIVNLAKANNAS<br>IVVESLEGGGLKQHGRKKNSRHRALNYALSLFDYGKIASLIKYKSDLEGVPMYEVLPAY<br>TSQQCAKCVLKKGSFVEPEIIGYIEEIGFKENLLTLLFEDTGLSSVQVLKKSKNKMTLSAR<br>DKEGKMVDLVLKYNFKGLVISQEKKKEEIVEFPIKEIDGKFAVLDSAYKRGKERISKKGN<br>QKLVYTGNKKVGYCSVHGQVDADLNASRVIALCKYLGINEPIVFGEQRKSFK |
| 75 | LDLITEPIQPHKSSSLRSKEFLEYQISDFLNFSLHSLFFGLASNEGPLVDFKIYDKIVIPKPEE<br>RFPKKESEEGKKLDSFDKRVEEYYSDKLEKKIERKLNTEEKNVIDREKTRIWGEVNKLEE<br>IRSIIDEINEIKKQKHISEKSKLLGEKWKKVNNIQETLLSQEYVSLISNLSDELTNKKKELL<br>AKKYSKFDDKIKKIKEDYGLEFDENTIKKEGEKAFLNPDKFSKYQFSSSYLKLIGEIARSLI<br>TYKGFLDLNKYPHFRKPINKVKKIHNLEPDEWKYYIQFGYEQINNPKLETENILGIDRGLT<br>HILAYSVFEPRSSKFILNKLEPNPIEGWKWKLRKLRRSIQNLERRWRAQDNVKLPENQM<br>KKNLRSIEDKVENLYHNLSRKIVDLAKEKNACIVFEKLEGQGMKQHGRKKSDRLRGLN<br>YKLSLFDYGKIAKLIKYKAEIEGIPIYRIDSAYTSQNCAKCVLESRRFAQPEEISCLDDFKE<br>GDNLDKRILEGTGLVEAKIYKLLKEKKEDFEIEEDIAMFDTKKVIKENKEKTVILDYVY<br>TRRKEIIGTNHKKNIKGIAKYTGNTKIGYCMKHGQVDADLNASRTIALCKNFDINNPEIW<br>K |
| 76 | MSDESLVSSEDKLAIKIKIVPNAEQAKMLDEMFKKWSSICNRISRGKEDIETLRPDEGKEL<br>QFNSTQLNSATMDVSDLKKAMARQGERLEAEVSKLRGRYETIDASLRDPSRRHTNPQKP<br>SSFYPSDWDISGRLTPRFHTARHYSTELRKLKAKEDKMLKTINKIKNGKIVFKPKRITLWP<br>SSVNMAFKGSRLLLKPFANGFEMELPIVISPQKTADGKSQKASAEYMRNALLGLAGYSIN<br>QLLFGMNRSQKMLANAKKPEKVEKFLEQMKNDANFDKKIKALEGKWLLDRKLKESE<br>KSSIAVVRTKFFKSGKVELNEDYLKLLKHMANEILERDGFVNLNKYPILSRKPMKRYKQ<br>KNIDNLKPNMWKYYIQFGYEPIFERKASGKPKNIMGIDRGLTHLLAVAVFSPDQQKFLFN<br>HLESNPIMHWKWKLRKIRRSIQHMERRIRAEKNKHIHEAQLKKRLGSIEEKTEQHYHIVS<br>SKIINWAIEYEAAIVLESLSHMKQRGGKKSVRTRALNYALSLFDYEKVARLITYKARIRGI<br>PVYDVLPGMTSKTCATCLLNGSQGAYVRGLETTKAAGKATKRKNMKIGKCMVCNSSE<br>NSMIDADLNAARVIAICKYKNLNDPQPAGSRKVFKRF |
| 77 | MLALKLKIMPTEKQAEILDAMFWKWASICSRIAKMKKKVSVKENKKELSKKIPSNSDIW<br>FSKTQLCQAEVDVGDHKKALKNFEKRQESLLDELKYKVKAINEVINDESKREIDPNNPS<br>KFRIKDSTKKGNLNSPKFFTLKKWQKILQENEKRIKKKESTIEKLKRGNIFFNPTKISLHEE<br>EYSINFGSSKLUNCFYKYNKKSGINSDQLENKFNEFQNGLNIICSPLQPIRGSSKRSFEFIR<br>NSIINFLMYSLYAKLFGIPRSVKALMKSNKDENKLKLEEKLKKKKSSFNKTVKEFEKMIG<br>RKLSDNESKILNDESKKFFEIIKSNNKYIPSEEYLKLLKDISEEIYNSNIDFKPYKYSILIRKP<br>LSKFKSKKLYNLKPTDYKYYLQLSYEPFSKQLIATKTILGIDRGLKHLLAVSVFDPSQNKF<br>VYNKLIKNPVFKWKKRYHDLKRSIRNRERRIRALTGVHIHENQLIKKLKSMKNKINVLY<br>HNVSKNIVDLAKKYESTIVLERLENLKQHGRSKGKRYKKLNYVLSNFDYKKIESLISYKA<br>KKEGVPVSNINPKYTSKTCAKCLLEVNQLSELKNEYNRDSKNSKIGICNIHGQIDADLNA<br>ARVIALCYSKNLEPHFK |
| 78 | VINLFGYKFALYPNKTQEELLNKHLGECGWLYNKAIEQNEYYKADSNIEEAQKKFELLP<br>DKNSDEAKVLRGNISKDNYVYRTLVKKKKSEINVQIRKAVVLRPAETIRNLAKVKKKGL<br>SVGRLKFIPIREWDVLPFKQSDQIRLEENYLILEPYGRLKFKMHRPLLGKPKTFCIKRTAT<br>DRWTISFSTEYDDSNMRKNDGGQVGIDVGLKTHLRLSNENPDEDPRYPNPKIWKRYDRR<br>LTILQRRISKSKKLGKNRTRLRLRLSRLWEKIRNSRADLIQONETYEILSENKLIAIEDLNVK<br>GMQEKKDKKGRKGRTRAQEKGLHRSISDAAFSEFRRVLEYKAKRFGSEVKPVSAIDSSK<br>ECHNCGNKKGMPLESRIYECPKCGLKIDRDLNSAKVILARATGVRPGSNARADTKISATA<br>GASVQTEGTVSEDFRQQMETSDQKPMQGEGSKEPPMNPEHKSSGRGSKHVNIGCKNKV<br>GLYNEDENSRSTEKQIMDENRSTTEDMVEIGALHSPVLTT |
| 79 | MIASIDYEAVSQALIVFEFKAKGKDSQYQAIDEAIRSYRFIRNSCLRYWMDNKKVGKYD<br>LNKYCKVLAKQYPFANKLNSQARQSAAECSWSAISRFYDNCKRKVSGKKGFPKFKKHA<br>RSVEYKTSGWKLSENRKAITFTDKNGIGKLKLKGTYDLHFSQLEDMKRVRLVRRADGY<br>YVQFCISVDVKVETEPTGKAIGLDVGIKYFLADSSGNTIENPQFYRKAEKKLNRANRRKS<br>KKYIRGVKPQSKNYHKARCRYARKHLRVSRQRKEYCKRVAYCVIHSNDVVAYEDLNV<br>KGMVKNRHLAKSISDVAWSTFRHWLEYFAIKYGKLTIPVAPHNTSQNCSNCDKKVPKSL<br>STRTHICHHCGYSEDRDVNAAKNILKKALSTVGQTGSLKLGEIEPLLVLEQSCTRKFDL |
| 80 | LAEENTLHLTLAMSLPLNDLPENRTRSELWRRQWLPQKKLSLLLGVNQSVRKAAADCL<br>RWFEPYQELLWWEPTDPDGKKLLDKEGRPIKRTAGHMRVLRKLEEIAPFRGYQLGSAV<br>KNGLRHKVADLLLSYAKRKLDPQFTDKTSYPSIGDQFPIVWTGAFVCYEQSITGQLYLYL<br>PLFPRGSHQEDITNNYDPDRGPALQVFGEKEIARLSRSTSGLLLPLQFDKWGEATFIRGEN<br>NPPTWKATHRRSDKKWLSEVLLREKDFQPKRVELLVRNGRIPVNVACEIPTKPLLEVENF<br>MGVSFGLEHLVTVVVINRDGNVVHQREPARRYEKTYFARLERLRRRGGPFSQELETFH<br>YRQVAQIVEEALRFKSVPAVEQVGNIPKGRYNPRLNLRLSYWPFGKLADLTSYKAVKEG<br>LPKPYSVYSATAKMLCSTCGAANKEGDQPISLKGPTVYCGNCGTRHNTGFNTALNLARR<br>AQELFVKGVVAR |

TABLE 2-continued

Cas14 Protein Sequences

| SEQ ID NO | Sequence |
|---|---|
| 81 | MSQSLLKWHDMAGRDKDASRSLQKSAVEGVLLHLTASHRVALEMLEKSVSQTVAVTM<br>EAAQQRLVIVLEDDPTKATSRKRVISADLQFTREEFGSLPNWAQKLASTCPEIATKYADK<br>HINSIRIAWGVAKESTNGDAVEQKLQWQIRLLDVTMFLQQLVLQLADKALLEQIPSSIRG<br>GIGQEVAQQVTSHIQLLDSGTVLKAELPTISDRNSELARKQWEDAIQTVCTYALPFSRER<br>ARILDPGKYAAEDPRGDRLINIDPMWARVLKGPTVKSLPLLFVSGSSIRIVKLTLPRKHAA<br>GHKHTFTATYLVLPVSREWINSLPGTVQEKVQWWKKPDVLATQELLVGKGALKKSANT<br>LVIPISAGKKRFFNHILPALQRGFPLQWQRIVGRSYRRPATHRKWFAQLTIGYTNPSSLPE<br>MALGIHFGMKDILWWALADKQGNILKDGSIPGNSILDFSLQEKGKIERQQKAGKNVAGK<br>KYGKSLLNATYRVVNGVLEFSKGISAEHASQPIGLGLETIRFVDKASGSSPVNARHSNWN<br>YGQLSGIFANKAGPAGFSVTEITLKKAQRDLSDAEQARVLAIEATKRFASRIKRLATKRK<br>DDTLFV |
| 82 | VEPVEKERFYYRTYTFRLDGQPRTQNLTTQSGWGLLTKAVLDNTKHYWEIVHHARIAN<br>QPIVFENPVIDEQGNPKLNKLGQPRFWKRPISDIVNQLRALFENQNPYQLGSSLIQGTYW<br>DVAENLASWYALNKEYLAGTATWGEPSFPEPHPLTEINQWMPLTFSSGKVVRLLKNAS<br>GRYFIGLPILGENNPCYRMRTIEKLIPCDGKGRVTSGSLILFPLVGIYAQQHRRMTDICESI<br>RTEKGKLAWAQVSIDYVREVDKRRRMRRTRKSQGWIQGPWQEVFILRLVLAHKAPKLY<br>KPRCFAGISLGPKTLASCVILDQDERVVEKQQWSGSELLSLIHQGEERLRSLREQSKPTW<br>NAAYRKQLKSLINTQVFTIVTFLRERGAAVRLESIARVRKSTPAPPVNFLLSHWAYRQITE<br>RLKDLAIRNGMPLTHSNGSYGVRFTCSQCGATNQGIKDPTKYKVDIESETFLCSICSHREI<br>AAVNTATNLAKQLLDE |
| 83 | MNDTETSETLTSHRTVCAHLHVVGETGSLPRLVEAALAELITLNGRATQALLSLAKNGL<br>VLRRDKEENLIAAELTLPCRKNKYADVAAKAGEPILATRINNKGKLVTKKWYGEGNSY<br>HIVRFTPETGMFTVRVFDRYAFDEELLHLHSEVVFGSDLPKGIKAKTDSLPANFLQAVFT<br>SFLELPFQGFPDIVVKPAMKQAAEQLLSYVQLEAGENQQAEYPDTNERDPELRLVEWQK<br>SLHELSVRTEPPEFVRARDIDYYAETDRRGNRFVNITPEWTKFAESPFARRLPLKIPPEFCI<br>LLRRKTEGHAKIPNRIYLGLQIFDGVTPDSTLGVLATAEDGKLFWWHDHLDEFSNLEGK<br>PEPKLKNKPQLLMVSLEYDREQRFEESVGGDRKICLVTLKETRNFRRGWNGRILGIHFQH<br>NPVITWALMDHDAEVLEKGFIEGNAFLGKALDKQALNEYLQKGGKWVGDRSFGNKLK<br>GITHTLASLIVRLAREKDAWIALEEISWVQKQSADSVANHEIVEQPHHSLTR |
| 84 | MNDTETSETLTSHRTVCAHLHVVGETGSLPRLVEAALAELITLNGRATQALLSLAKNGL<br>VLRRDKEENLIAAELTLPCRKNKYADVAAKAGEPILATRINNKGKLVTKKWYGEGNSY<br>HIVRFTPETGMFTVRVFDRYAFDEELLHLHSEVVFGSDLPKGIKAKTDSLPANFLQAVFT<br>SFLELPFQGFPDIVVKPAMKQAAEQLLSYVQLEAGENQQAEYPDTNERDPELRLVEWQK<br>SLHELSVRTEPPEFVRARDIDYYAETDRRGNRFVNITPEWTKFAESPFARRLPLKIPPEFCI<br>LLRRKTEGHAKIPNRIYLGLQIFDGVTPDSTLGVLATAEDGKLFWWHDHLDEFSNLEGK<br>PEPKLKNKPQLLMVSLEYDREQRFEESVGGDRKICLVTLKETRNFRRGRHGHTRTDRLP<br>AGNTLWRADFATSAEVAAPKWNGRILGIHFQHNPVITWALMDHDAEVLEKGFIEGNAF<br>LGKALDKQALNEYLQKGGKWVGDRSFGNKLKGITHTLASLIVRLAREKDAWIALEEIS<br>WVQKQSADSVANRRFSMWNYSRLATLIEWLGTDIATRDCGTAAPLAHKVSDYLTHFTC<br>PECGACRKAGQKKEIADTVRAGDILTCRKCGFSGPIPDNFIAEFVAKKALERMLKKKPV |
| 85 | MAKRNFGEKSEALYRAVRFEVRPSKEELSILLAVSEVLRMLFNSALAERQQVFTEFIASL<br>YAELKSASVPEEISEIRKKLREAYKEHSISLFDQINALTARRVEDEAFASVTRNWQEETLD<br>ALDGAYKSFLSLRRKGDYDAHSPRSRDSGFFQKIPGRSGFKIGEGRIALSCGAGRKLSFPI<br>PDYQQGRLAETTKLKKFELYRDQPNLAKSGRFWISVVYELPKPEATTCQSEQVAFVALG<br>ASSIGVVSQRGEEVIALWRSDKHWVPKIEAVEERMKRRVKGSRGWLRLLNSGKRRMH<br>MISSRQHVQDEREIVDYLVRNHGSHFVVTELVVRSKEGKLADSSKPERGGSLGLNWAA<br>QNTGSLSRLVRQLEEKVKEHGGSVRKHKLTLTEAPPARGAENKLWMARKLRESFLKEV |
| 86 | LAKNDEKELLYQSVKFEIYPDESKIRVLTRVSNILVLVWNSALGERRARFELYIAPLYEEL<br>KKFPRKSAESNALRQKIREGYKEHIPTFFDQLKKLLTPMRKEDPALLGSVPRAYQEETLN<br>TLNGSFVSFMTLRRNNDMDAKPPKGRAEDRFHEISGRSGFKIDGSEFVLSTKEQKLRFPIP<br>NYQLEKLKEAKQIKKFTLYQSRDRRFWISIAYEIELPDQRPFNPEEVIYIAFGASSIGVISPE<br>GEKVIDFWRPDKHWKPKIKEVENRMRSCKKGSRAWKKRAAARRKMYAMTQRQQKLN<br>HREIVASLLRLGFHFVVTEYTVRSKPGKLADGSNPKRGGAPQGFNWSAQNTGSFGEFIL<br>WLKQKVKEQGGTVQTFRLVLGQSERPEKRGRDNKIEMVRLLREKYLESQTIVV |
| 87 | MAKGKKKEGKPLYRAVRFEIFPTSDQITLFLRVSKNLQQVWNEAWQERQSCYEQFFGSI<br>YERIGQAKKRAQEAGFSEVWENEAKKGLNKKLRQQEISMQLVSEKESLLQELSIAFQEH<br>GVTLYDQINGLTARRIIGEFALIPRNWQEETLDSLDGSFKSFLALRKNGDPDAKPPRQRVS<br>ENSFYKIPGRSGFKVSNGQIYLSFGKIGQTLTSVIPEFQLKRLETAIKLKKFELCRDERDMA<br>KPGRFWISVAYEIPKPEKVPVVSKQITYLAIGASRLGVVSPKGEFCLNLPRSDYHWKPQIN<br>ALQERLEGVVKGSRKWKKRMAACTRMFAKLGHQQKQHGQYEVVKKLLRHGVHFVVT<br>ELKVRSKPGALADASKSDRKGSPTGPNWSAQNTGNIARLIQKLTDKASEHGGTVIKRNP<br>PLLSEERQLPDAQRKIFIAKKLREEFLADQK |
| 88 | MAKREKKDDVVLRGTKMRIYPTDRQVTLMDMWRRRCISLWNLLLNLETAAYGAKNTR<br>SKLGWRSIWARVVEENHAKALIVYQHGKCKKDGSFVLKRDGTVKHPPRERFPGDRKILL<br>GLFDALRHTLDKGAKCKCNVNQPYALTRAWLDETGHGARTADIIAWLKDFKGECDCT<br>AISTAAKYCPAPPTAELLTKIKRAAPADDLPVDQAILLDLFGALRGGLKQKECDHTHART<br>VAYFEKHELAGRAEDILAWLIAHGGTCDCKIVEEAANHCPGPRLFIWEHELAMIMARLK |

TABLE 2-continued

Cas14 Protein Sequences

| SEQ ID NO | Sequence |
|---|---|
| | AEPRTEWIGDLPSHAAQTVVKDLVKALQTMLKERAKAAAGDESARKTGFPKFKKQAY AAGSVYFPNTTMFFDVAAGRVQLPNGCGSMRCEIPRQLVAELLERNLKPGLVIGAQLGL LGGRIWRQGDRWYLSCQWERPQPTLLPKTGRTAGVKIAASIVFTTYDNRGQTKEYPMPP ADKKLTAVHLVAGKQNSRALEAQKEKEKKLKARKERLRLGKLEKGHDPNALKPLKRP RVRRSKLFYKSAARLAACEAIERDRRDGFLHRVTNEIVHKFDAVSVQKMSVAPMMRRQ KQKEKQIESKKNEAKKEDNGAAKKPRNLKPVRKLLRHVAMARGRQFLEYKYNDLRGP GSVLIADRLEPEVQECSRCGTKNPQMKDGRRLLRCIGVLPDGTDCDAVLPRNRNAARNA EKRLRKHREAHNA |
| 89 | MNEVLPIPAVGEDAADTIMRGSKMRIYPSVRQAATMDLWRRCIQLWNLLLELEQAAY SGENRRTQIGWRSIWATVVEDSHAEAVRVAREGKKRKDGTFRKAPSGKEIPPLDPAMLA KIQRQMNGAVDVDPKTGEVTPAQPRLFMWEHELQKIMARLKQAPRTHWIDDLPSHAAQ SVVKDLIKALQAMLRERKKRASGIGGRDTGFPKFKKNRYAAGSVYFANTQLRFEAKRG KAGDPDAVRGEFARVKLPNGVGWMECRMPRHINAAHAYAQATLMGGRIWRQGENWY LSCQWKMPKPAPLPRAGRTAAIKIAAAIPITTVDNRGQTREYAMPPIDRERIAAHAAAGR AQSRALEARKRRAKKREAYAKKRHAKKLERGIAAKPPGRARIKLSPGFYAAAAKLAKL EAEDANAREAWLHEITTQIVRNFDVIAVPRMEVAKLMKKPEPPEEKEEQVKAPWQGKR RSLKAARVMMRRTAMALIQTTLKYKAVDLRGPQAYEEIAPLDVTAAACSGCGVLKPEW KMARAKGREIMRCQEPLPGGKTCNTVLTYTRNSARVIGRELAVRLAERQKA |
| 90 | MTTQKTYNFCFYDQRFFELSKEAGEVYSRSLEEFWKIYDETGVWLSKFDLQKHMRNKL ERKLLHSDSFLGAMQQVHANLASWKQAKKVVPDACPPRKPKFLQAILFKKSQIKYKNG FLRLTLGTEKEFLYLKWDINIPLPIYGSVTYSKTRGWKINLCLETEVEQKNLSENKYLSID LGVKRVATIPDGENTITLSGKKFMGLMHYRNKLNGKTQSRLSHKKKGSNNYKKIQRAK RKTTDRLLNIQKEMLHKYSSFIVNYAIRNDIGNIIIGDNSSTHDSPNMRGKTNQKISQNPE QKLKNYIKYKFESISGRVDIVPEPYTSRKCPHCKNIKKSSPKGRTYKCKKCGFIFDRDGVG AINIYNENVSFGQIISPGRIRSLTEPIGMKFHNEIYFKSYVAA |
| 91 | MSVRSFQARVECDKQTMEHLWRTHKVFNERLPEIIKILFKMKRGECGQNDKQKSLYKSI SQSILEANAQNADYLLNSVSIKGWKPGTAKKYRNASFTWADDAAKLSSQGIHVYDKKQ VLGDLPGMMSQMVCRQSVEAISGHIELTKKWEKEHNEWLKEKEKWESEDEHKKYLDL REKFEQFEQSIGGKITKRRGRWHLYLKWLSDNPDFAAWRGNKAVINPLSEKAQIRINKA KPNKKNSVERDEFFKANPEMKALDNLHGYYERNFVRRRKTKKNPDGFDHKPTFTLPHP TIHPRWFVFNKPKTNPEGYRKLILPKKAGDLGSLEMRLLTGEKNKGNYPDDWISVKFKA DPRLSLIRPVKGRRVVRKGKEQGQTKETDSYEFFDKHLKKWRPAKLSGVKLIFPDKTPK AAYLYFTCDIPDEPLTETAKKIQWLETGDVTKKGKKRKKKVLPHGLVSCAVDLSMRRG TTGFATLCRYENGKIHILRSRNLWVGYKEGKGCHPYRWTEGPDLGHIAKHKREIRILRSK RGKPVKGEESHIDLQKHIDYMGEDRFKKAARTIVNFALNTENAASKNGFYPRADVLLLE NLEGLIPDAEKERGINRALAGWNRRHLVERVIEMAKDAGFKRRVFEIPPYGTSQVCSKC GALGRRYSIIRENNRREIRFGYVEKLFACPNCGYCANADHNASVNLNRRFLIEDSFKSYY DWKRLSEKKQKEEIETIESKLMDKLCAMHKISRGSISK |
| 92 | MHLWRTHCVFNQRLPALLKRLFAMRRGEVGGNEAQRQVYQRVAQFVLARDAKDSVD LLNAVSLRKRSANSAFKKKATISCNGQAREVTGEEVFAEAVALASKGVFAYDKDDMRA GLPDSLFQPLTRDAVACMRSHEELVATWKKEYREWRDRKSEWEAEPEHALYLNLRPKF EEGEAARGGRFRKRAERDHAYLDWLEANPQLAAWRRKAPPAVVPIDEAGKRRIARAKA WKQASVRAEEFWKRNPELHALHKIHVQYLREFVRPRRTRRNKRREGFKQRPTFTMPDP VRHPRWCLFNAPQTSPQGYRLLRLPQSRRTVGSVELRLLTGPSDGAGFPDAWVNVRFKA DPRLAQLRPVKVPRTVTRGKNKGAKVEADGFRYYDDQLLIERDAQVSGVKLLFRDIRM APFADKPIEDRLLSATPYLVFAVEIKDEARTERAKAIRFDETSELTKSGKKRKTLPAGLVS VAVDLDTRGVGFLTRAVIGVPEIQQTHHGVRLLQSRYVAVGQVEARASGEAEWSPGPD LAHIARHKREIRRLRQLRGKPVKGERSHVRLQAHIDRMGEDRFKKAARKIVNEALRGSN PAAGDPYTRADVLLYESLETLLPDAERERGINRALLRWNRAKLIEHLKRMCDDAGIRHF PVSPFGTSQVCSKCGALGRRYSLARENGRAVIRFGWVERLFACPNPECPGRRPDRPDRPF TCNSDHNASVNLHRVFALGDQAVAAFRALAPRDSPARTLAVKRVEDTLRPQLMRVHKL ADAGVDSPF |
| 93 | MATLVYRYGVRAHGSARQQDAVVSDPAMLEQLRLGHELRNALVGVQHRYEDGKRAV WSGFASVAAADHRVTTGETAVAELEKQARAEHSADRTAATRQGTAESLKAARAAVKQ ARADRKAAMAAVAEQAKPKIQALGDDRDAEIKDLYRRFCQDGVLLPRCGRCAGDLRS DGDCTDCGAAHEPRKLYWATYNAIREDHQTAVKLVEAKRKAGQPARLRFRRWTGDGT LTVQLQRMHGPACRCVTCAEKLTRRARKTDPQAPAVAADPAYPPTDPPRDPALLASGQ GKWRNVLQLGTWIPPGEWSAMSRAERRRVGRSHIGWQLGGGRQLTLPVQLHRQMPAD ADVAMAQLTRVRVGGRHRMSVALTAKLPDPPVQGLPPVALHLGWRQRPDGSLRVAT WACPQPLDLPPAVADVVVSHGGRWGEVIMPARWLADAEVPPRLLGRRDKAMEPVLEA LADWLEAHTEACTARMTPALVRRWRSQGRLAGLTNRWRGQPPTGSAEILTYLEAWRIQ DKLLWERESHLRRRLAARRDDAWRRVASWLARHAGVLVVDDADIAELRRRDDPADTD PTMPASAAQAARARAALAAPGRLRHLATITATRDGLGVHTVASAGLTRLHRKCGHQAQ PDPRYAASAVVTCPGCGNGYDQDYNAAMLMLDRQQQP |
| 94 | MSRVELHRAYKPFRLYPTPAQVAELAEWERQLRRLYNLAHSQRLAAMQRHVRPKSPGVL KSECLSCGAVAVAEIGTDGKAKKTVKHAVGCSVLECRSCGGSPDAEGRTAHTAACSFV DYYRQGREMTQLLEEDDQLARVVCSARQETLRDLEKAWQRWHKMPGFGKPHFKKRID SCRIYFSTPKSWAVDLGYLSFTGVASSVGRIKIRQDRVWPGDAKFSSCHVVRDVDEWYA |

TABLE 2-continued

Cas14 Protein Sequences

| SEQ ID NO | Sequence |
|---|---|
| | VFPLTFTKEIEKPKGGAVGINRGAVHAIADSTGRVVDSPKFYARSLGVIRHRARLLDRKV PPGRAVKPSPTKYHGLPKADIDAAAARVNASPGRLVYEARARGSIAAAEAHLAALVLPA PRQTSQLPSEGRNRERARRFLALAHQRVRRQREWFLHNESAHYAQSYTKIAIEDWSTKE MTSSEPRDAEEMKRVTRARNRSILDVGWYELGRQIAYKSEATGAEFAKVDPGLRETETH VPEAIVRERDVDVSGMLRGEAGISGTCSRCGGLLRASASGHADAECEVCLHVEVGDVN AAVNVLKRAMFPGAAPPSKEKAKVTIGIKGRKKKRAA |
| 95 | MSRVELHRAYKFRLYPTPVQVAELSEWERQLRRLYNLGHEQRLLTLTRHLRPKSPGVLK GECLSCDSTQVQEVGADGRPKTTVRHAEQCPTLACRSCGALRDAEGRTAHTVACAFVD YYRQGREMTELLAADDQLARVVCSARQEVLRDLDKAWQRWRKMPGFGKPRFKRRTD SCRIYFSTPKAWKLEGGHLSFTGAATTVGAIKMRQDRNWPASVQFSSCHVVRDVDEWY AVFPLTFVAEVARPKGGAVGINRGAVHAIADSTGRVVDSPRYYARALGVIRHRARLFDR KVPSGHAVKPSPTKYRGLSAIEVDRVARATGFTPGRVVTEALNRGGVAYAECALAAIAV LGHGPERPLTSDGRNREKARKFLALAHQRVRRQREWFLHNESAHYARTYSKIAIEDWST KEMTASEPQGEETRRVTRSRNRSILDVGWYELGRQLAYKTEATGAEFAQVDPGLKETET NVPKAIADARDVDVSGMLRGEAGISGTCSCKCGGLLRAPASGHADAECEICLNVEVGDV NAAVNVLKRAMFPGDAPPASGEKPKVSIGIKGRQKKKKAA |
| 96 | MEAIATGMSPERRVELGILPGSVELKRAYKFRLYPMKVQQAELSEWERQLRRLYNLAHE QRLAALLRYRDWDFQKGACPSCRVAVPGVHTAACDHVDYFRQAREMTQLLEVDAQLS RVICCARQEVLRDLDKAWQRWRKKLGGRPRFKRRTDSCRIYLSTPKHWEIAGRYLRLSG LASSVGEIRIEQDRAFPEGALLSSCSIVRDVDEWYACLPLTFTQPIERAPHRSVGLNRGVV HALADSDGRVVDSPKFFERALATVQKRSRDLARKVSGSRNAHKARIKLAKAHQRVRRQ RAAFLHQESAYYSKGFDLVALEDMSVRKMTATAGEAPEMGRGAQRDLNRGILDVGWY ELARQIDYKRLAHGGELLRVDPGQTTPLACVTEEQPARGISSACAVCGIPLARPASGNAR MRCTACGSSQVGDVNAAENVLTRALSSAPSGPKSPKASIKIKGRQKRLGTPANRAGEAS GGDPPVRGPVEGGTLAYVVEPVSESQSDT |
| 97 | MTVRTYKYRAYPTPEQAEALTSWLRFASQLYNAALEHRKNAWGRHDAHGRGFRFWD GDAAPRKKSDPPGRWVYRGGGGAHISKNDQGKLLTEFRREHAELLPPGMPALVQHEVL ARLERSMAAFFQRATKGQKAGYPRWRSEHRYDSLTFGLTSPSKERFDPETGESLGRGKT VGAGTYHNGDLRLTGLGELRILEHRRIPMGAIPKSVIVRRSGKRWFVSIAMEMPSVEPAA SGRPAVGLDMGVVTWGTAFTADTSAAAALVADLRRMATDPSDCRRLEELEREAAQLSE VLAHCRARGLDPARPRRCPKELTKLYRRSLHRLGELDRACARIRRRLQAAHDIAEPVPD EAGSAVLIEGSNAGMRHARRVARTQRRVARRTRAGHAHSNRRKKAVQAYARAKERER SARGDHRHKVSRALVRQFEEISVEALDIKQLTVAPEHNPDPQPDLPAHVQRRRNRGELD AAWGAFFAALDYKAADAGGRVARKPAPHTTQECARCGTLVPKPISLRVHRCPACGYTA PRTVNSARNVLQRPLEEPGRAGPSGANGRGVPHAVA |
| 98 | MNCRYRYRIYPTPGQRQSLARLFGCVRVVWNDALFLCRQSEKLPKNSELQKLCITQAKK TEARGWLGQVSAIPLQQSVADLGVAFKNFFQSRSGKRKGKKVNPPRVKRRNNRQGARF TRGGFKVKTSKVYLARIGDIKIKWSRPLPSEPSSVTVIKDCAGQYFLSFVVEVKPEIKPPK NPSIGIDLGLKTFASCSNGEKIDSPDYSRLYRKLKRCQRRLAKRQRGSKRRERMRVKVA KLNAQIRDKRKDFLHKLSTKVVNENQVIALEDLNVGGMLKNRKLSRAISQAGWYEFRS LCEGKAEKHNRDFRVISRWEPTSQVCSECGYRWGKIDLSVRSIVCINCGVEHDRDDNAS VNIEQAGLKVGVGHTHDSKRTGSACKTSNGAVCVEPSTHREYVQLTLFDW |
| 99 | MKSRWTFRCYPTPEQEQHLARTFGCVRFVWNWALRARTDAFRAGERIGYPATDKALTL LKQQPETVWLNEVSSVCLQQALRDLQVAFSNFFDKRAAHPSFKRKEARQSANYTERGFS FDHERRILKLAKIGAIKVKWSRKAIPHPSSIRLIRTASGKYFVSLVVETQPAPMPETGESVG VDFGVARLATLSNGERISNPKHGAKWQRRLAFYQKRLARATKGSKRRMIKRHVARIH EKIGNSRSDTLHKLSTDLVTRFDLICVEDLNLRGMVKNHSLARSLHDASIGSAIRMIEEKA ERYGKNVVKIDRWFPSSKTCSDCGHIVEQLPLNVREWTCPECGTTHDRDANAAANILAV GQTVSAHGGTVRRSRAKASERKSQRSANRQGVNRA |
| 100 | KEPLNIGKTAKAVFKEIDPTSLNRAANYDASIELNCKECKFKPFKNVKRYEFNFYNNWY RCNPNSCLQSTYKAQVRKVEIGYEKLKNEILTQMQYYPWFGRLYQNFFHDERDKMTSL DEIQVIGVQNKVFFNTVEKAWREIIKKRFKDNKETMETIPELKHAAGHGKRKLSNKSLLR RRFAFVQKSFKFVDNSDVSYRSFSNNIACVLPSRIGVDLGGVISRNPKREYIPQEISFNAF WKQHEGLKKGRNIEIQSVQYKGETVKRIEADTGEDKAWGKNRQRRFTSLILKLVPKQG GKKVWKYPEKRNEGNYEYFPIPIEFILDSGETSIRFGGDEGEAGKQKHLVIPFNDSKATPL ASQQTLLENSRFNAEVKSCIGLAIYANYFYGYARNYVISSIYHKNSKNGQAITAIYLESIA HNYVKAIERQLQNLLLNLRDFSFMESHKKELKKYFGGDLEGTGGAQKRREKEEKIEKEI EQSYLPRLIRLSLTKMVTKQVEM |
| 101 | ELIVNENKDPLNIGKTAKAVFKEIDPTSINRAANYDASIELACKECKFKPFNNTKRHDFSF YSNWHRCSPNSCLQSTYRAKIRKTEIGYEKLKNEILNQMQYYPWFGRLYQNFFNDQRDK MTSLDEIQVTGVQNKIFFNTVEKAWREIIKKRFRDNKETMRTIPDLKNKSGHGSRKLSNK SLLRRRFAFAQKSFKLVDNSDVSYRAFSNNVACVLPSKIGVDIGGIINKDLKREYIPQEITF NVFWKQHDGLKKGRNIEIHSVQYKGEIVKRIEADTGEDKAWGKNRQRRFTSLILKITPK QGGKKIWKFPEKKNASDYEYFPIPIEFILDNGDASIKFGGEEGEVGKQKHLLIPFNDSKAT PLSSKQMLLETSRFNAEVKSTIGLALYANYFVSYARNYVIKSTYHKNSKKGQIVTEIYLES ISQNFVRAIQRQLQSLMLNLKDWGFMQTHKKELKKYFGSDLEGSKGGQKRREKEEKIEK EIEASYLPRLIRLSLTKSVTKAEEM |

TABLE 2-continued

Cas14 Protein Sequences

| SEQ ID NO | Sequence |
|---|---|
| 102 | PEEKTSKLKPNSINLAANYDANEKFNCKECKFHPFKNKKRYEFNFYNNLHGCKSCTKST<br>NNPAVKRIEIGYQKLKFEIKNQMEAYPWFGRLRINFYSDEKRKMSELNEMQVTGVKNKI<br>FFDAIECAWREILKKRFRESKETLITIPKLKNKAGHGARKHRNKKLLIRRRAFMKKNFHF<br>LDNDSISYRSFANNIACVLPSKVGVDIGGIISPDVGKDIKPVDISLNLMWASKEGIKSGRK<br>VEIYSTQYDGNMVKKIEAETGEDKSWGKNRKRRQTSLLLSIPKPSKQVQEFDFKEWPRY<br>KDIEKKVQWRGFPIKIIFDSNHNSIEFGTYQGGKQKVLPIPFNDSKTTPLGSKMNKLEKLR<br>FNSKIKSRLGSAIAANKFLEAARTYCVDSLYHEVSSANAIGKGKIFIEYYLEILSQNYIEAA<br>QKQLQRFIESIEQWFVADPFQGRLKQYFKDDLKRAKCFLCANREVQTTCYAAVKLHKSC<br>AEKVKDKNKELAIKERNNKEDAVIKEVEASNYPRVIRLKLTKTITNKAM |
| 103 | SESENKIIEQYYAFLYSFRDKYEKPEFKNRGDIKRKLQNKWEDFLKEQNLKNDKKLSNYI<br>FSNRNFRRSYDREEENEEGIDEKKSKPKRINCFEKEKNLKDQYDKDAINASANKDGAQK<br>WGCFECIFFPMYKIESGDPNKRIIINKTRFKLFDFYLNLKGCKSCLRSTYHPYRSNVYIESN<br>YDKLKREIGNFLQQKNIFQRMRKAKVSEGKYLTNLDEYRLSCVAMHFKNRWLFFDSIQ<br>KVLRETIKQRLKQMRESYDEQAKTKRSKGHGRAKYEDQVRMIRRRAYSAQAHKLLDN<br>GYITLFDYDDKEINKVCLTAINQEGFDIGGYLNSDIDNVMPPIEISFHLKWKYNEPILNIES<br>PFSKAKISDYLRKIREDLNLERGKEGKARSKKNVRRKVLASKGEDGYKKIFTDFFSKWK<br>EELEGNAMERVLSQSSGDIQWSKKKRIHYTTLVLNINLLDKKGVGNLKYYEIAEKTKILS<br>FDKNENKFWPITIQVLLDGYEIGTEYDEIKQLNEKTSKQFTIYDPNTKIIKIPFTDSKAVPL<br>GMLGINIATLKTVKKTERDIKVSKIFKGGLNSKIVSKIGKGIYAGYFPTVDKEILEEVEEDT<br>LDNEFSSKSQRNIFLKSIIKNYDKMLKEQLFDFYSFLVRNDLGVRFLTDRELQNIEDESFN<br>LEKRFFETDRDRIARWFDNTNTDDGKEKFKKLANEIVDSYKPRLIRLPVVRVIKRIQPVK<br>QREM |
| 104 | KYSTRDFSELNEIQVTACKQDEFFKVIQNAWREIIKKRFLENRENFIEKKIFKNKKGRGKR<br>QESDKTIQRNRASVMKNFQLIENEKIILRAPSGHVACVFPVKVGLDIGGFKTDDLEKNIFP<br>PRTITINVFWKNRDRQRKGRKLEVWGIKARTKLIEKVHKWDKLEEVKKKRLKSLEQKQ<br>EKSLDNWSEVNNDSFYKVQIDELQEKIDKSLKGRTMNKILDNKAKESKEAEGLYIEWEK<br>DFEGEMLRRIEASTGGEEKWGKRRQRRHTSLLLDIKNNSRGSKEIINFYSYAKQGKKEKK<br>IEFFPFPLTITLDAEEESPLNIKSIPIEDKNATSKYFSIPFTETRATPLSILGDRVQKFKTKNIS<br>GAIKRNLGSSISSCKIVQNAETSAKSILSLPNVKEDNNMEIFINTMSKNYFRAMMKQMES<br>FIFEMEPKTLIDPYKEKAIKWFEVAASSRAKRKLKKLSKADIKKSELLLSNTEEFEKEKQE<br>KLEALEKEIEEFYLPRIVRLQLTKTILETPVM |
| 105 | KKLQLLGHKILLKEYDPNAVNAAANFETSTAELCGQCKMPFKNKRRFQYTFGKNYHG<br>CLSCIQNVYYAKKRIVQIAKEELKHQLTDSIASIPYKYTSLFSNTNSIDELYILKQERAAFF<br>SNTNSIDELYITGIENNIAFKVISAIWDEIIKKRRQRYAESLTDTGTVKANRGHGGTAYKS<br>NTRQEKIRALQKQTLHMVTNPYISLARYKNNYIVATLPRTIGMHIGAIKDRDPQKKLSDY<br>AINFNVFWSDDRQLIELSTVQYTGDMVRKIEAETGENNKWGENMKRTKTSLLLEILTKK<br>TTDELTFKDWAFSTKKEIDSVTKKTYQGFPIGIIFEGNESSVKFGSQNYFPLPFDAKITPPT<br>AEGFRLDWLRKGSFSSQMKTSYGLAIYSNKVTNAIPAYVIKNMFYKIARAENGKQIKAK<br>FLKKYLDIAGNNYVPFIIMQHYRVLDTFEEMPISQPKVIRLSLTKTQHIIIKKDKTDSKM |
| 106 | NTSNLINLGKKAINISANYDANLEVGCKNCKFLSSNGNFPRQTNVKEGCHSCEKSTYEPSI<br>YLVKIGERKAKYDVLDSLKKFTFQSLKYQSKKSMKSRNKKPKELKEFVIFANKNKAFDV<br>IQKSYNHLILQIKKEINRMNSKKRKKNHKRRLFRDREKQLNKLRLIESSNLFLPRENKGN<br>NHVFTYVAIHSVGRDIGVIGSYDEKLNFETELTYQLYFNDDKRLLYAIHKPKQNKIIKIKE<br>KLWNLRKEKEPLDLEYEKPLNKSITFSIKNDNLFKVSKDLMLRRAKFNIQGKEKLSKEER<br>KINRDLIKIKGLVNSMSYGRFDELKKEKNIWSPHIYREVRQKEIKPCLIKNGDRIEIFEQLK<br>KKMERLRRFREKRQKKISKDLIFAERIAYNFHTKSIKNTSNKINIDQEAKRGKASYMRKRI<br>GYETFKNKYCEQCLSKGNVYRNVQKGCSCFENPFDWIKKGDENLLPKKNEDLRVKGAF<br>RDEALEKQIVKIAFNIAKGYEDFYDNLGESTEKDLKLKFKVGTTINEQESLKL |
| 107 | TSNPIKLGKKAINISANYDSNLQIGCKNCKFLSYNGNFPRQTNVKEGCHSCEKSTYEPPV<br>YTVRIGERRSKYDVLDSLKKFIFLSLKYRQSKKMKTRSKGIRGLEEFVISANLKKAMDVI<br>QKSYRHLILNIKNEIVRMNGKKRNKNHKRLLFRDREKQLNKLRLIEGSSFFKPPTVKGDN<br>SIFTCVAIHNIGRDIGIAGDYFDKLEPKIELTYQLYYEYNPKKESEINKRLLYAYKPKQNKI<br>IEIKEKLWNLRKEKSPLDLEYEKPLTKSITFLVKRDGVFRISKDLMLRKAKFIIQGKEKLS<br>KEERKINRDLIKIKSNIISLTYGRFDELKKDKTIWSPHIFRDVKQGKITPCIERKGDRMDIFQ<br>QLRKKSERLRENRKKRQKKISKDLIFAERIAYNFHTKSIKNTSNLINIKHEAKRGKASYMR<br>KRIGNETFRIKYCEQCFPKNNVYKNVQKGCSCFEDPFEYIKKGNEDLIPNKNQDLKAKG<br>AFRDDALEKQIIKVAFNIAKGYEDFYENLKKTTEKDIRLKFKVGTIISEEM |
| 108 | NNSINLSKKAINISANYDANLQVRCKNCKFLSSNGNFPRQTDVKEGCHSCEKSTYEPPVY<br>DVKIGEIKAKYEVLDSLKKFTFQSLKYQLSKSMKFRSKKIKELKEFVIFAKESKALNVINR<br>SYKHLILNIKNDINRMNSKKRIKNHKGRLFLDRQKQLSKLKLIEGSSFFVPAKNVGNKSV<br>FTCVAIHSIGRDIGIAGLYDSFTKPVNEITYQIFFSGERRLLYAYKPKQLKILSIKENLWSLK<br>NEKKPLDLLYEKPLGKNLNFNVKGGDLFRVSKDLMIRNAKFNVHGRQRLSDEERLINRN<br>FIKIKGEVVSLSYGRFEELKKDRKLWSPHIFKDVRQNKIKPCLVMQGQRIDIFEQLKRKLE<br>LLKKIRKSRQKKLSKDLIFGERIAYNFHTKSIKNTSNKINIDSDAKRGRASYMRKRIGNET<br>FKLKYCDVCFPKANVYRRVQNGCSCSENPYNYIKKGDKDLLPKKDEGLAIKGAFRDEK<br>LNKQIIKVAFNIAKGYEDFYDDLKKRTEKDVDLKFKIGTTVLDQKPMEIFDGIVITWL |

TABLE 2-continued

Cas14 Protein Sequences

| SEQ ID NO | Sequence |
|---|---|
| 109 | LLTTVVETNNLAKKAINVAANFDANIDRQYYRCTPNLCRFIAQSPRETKEKDAGCSSCTQ STYDPKVYIKIGKLLAKYEILKSLKRFLFMNRYFKQKKTERAQQKQKIGTELNEMSIFA KATNAMEVIKRATKHCTYDIIPETKSLQMLKRRRHRVKVRSLLKILKERRMKIKKIPNTFI EIPKQAKKNKSDYYVAAALKSCGIDVGLCGAYEKNAEVEAEYTYQLYYEYKGNSSTKR ILYCYNNPQKNIREFWEAFYIQGSKSHVNTPGTIRLKMEKFLSPITIESEALDFRVWNSDL KIRNGQYGFIKKRSLGKEAREIKKGMGDIKRKIGNLTYGKSPSELKSIHVYRTERENPKKP RAARKKEDNFMEIFEMQRKKDYEVNKKRRKEATDAAKIMDFAEEPIRHYHTNNLKAVR RIDMNEQVERKKTSVFLKRIMQNGYRGNYCRKCIKAPEGSNRDENVLEKNEGCLDCIGS EFIWKKSSKEKKGLWHTNRLLRRIRLQCFTTAKAYENFYNDLFEKKESSLDIIKLKVSITT KSM |
| 110 | ASTMNLAKQAINFAANYDSNLEIGCKGCKFMSTWSKKSNPKFYPRQNNQANKCHSCTY STGEPEVPIIEIGERAAKYKIFTALKKFVFMSVAYKERRRQRFKSKKPKELKELAICSNRE KAMEVIQKSVVHCYGDVKQEIPRIRKIKVLKNHKGRLFYKQKRSKIKIAKLEKGSFFKTFI PKVHNNGCHSCHEASLNKPILVTTALNTIGADIGLINDYSTIAPTETDISWQVYYEFIPNG DSEAVKKRLLYFYKPKGALIKSIRDKYFKKGHENAVNTGFFKYQGKIVKGPIKFVNNEL DFARKPDLKSMKIKRAGFAIPSAKRLSKEDREINRESIKIKNKIYSLSYGRKKTLSDKDIIK HLYRPVRQKGVKPLEYRKAPDGFLEFFYSLKRKERRLRKQKEKRQKDMSEIIDAADEFA WHRHTGSIKKTTNHINFKSEVKRGKVPIMKKRIANDSFNTRHCGKCVKQGNAINKYYIE KQKNCFDCNSIEFKWEKAALEKKGAFKLNKRLQYIVKACFNVAKAYESFYEDFRKGEE ESLDLKFKIGTTTTLKQYPQNKARAM |
| 111 | HSHNLMLTKLGKQAINFAANYDANLEIGCKNCKFLSYSPKQANPKKYPRQTDVHEDGNI ACHSCMQSTKEPPVYIVPIGERKSKYEILTSLNKFTFLALKYKEKKRQAFRAKKPKELQE LAIAFNKEKAIKVIDKSIQHLILNIKPEIARIQRQKRLKNRKGKLLYLHKRYAIKMGLIKNG KYFKVGSPKKDGKKLLVLCALNTIGRDIGIIGNIEENNRSETEITYQLYFDCLDANPNELRI KEIEYNRLKSYERKIKRLVYAYKPKQTKILEIRSKFFSKGHENKVNTGSFNFENPLNKSISI KVKNSAFDFKIGAPFIMLRNGKFHIPTKKRLSKEEREINRTLSKIKGRVFRLTYGRNISEQG SKSLHIYRKERQHPKLSLEIRKQPDSFIDEFEKLRLKQNFISKLKKQRQKKLADLLQFADR IAYNYHTSSLEKTSNFINYKPEVKRGRTSYIKKRIGNEGFEKLYCETCIKSNDKENAYAVE KEELCFVCKAKPFTWKKTNKDKLGIFKYPSRIKDFIRAAFTVAKSYNDFYENLKKKDLK NEIFLKFKIGLILSHEKKNHISIAKSVAEDERISGKSIKNILNKSIKLEKNCYSCFFHKEDM |
| 112 | SLERVIDKRNLAKKAINIAANFDANINKGFYRCETNQCMFIAQKPRKTNNTGCSSCLQST YDPVIYVVKVGEMLAKYEILKSLKRFVFMNRSFKQKKTEKAKQKERIGGELNEMSIFAN AALAMGVIKRAIRHCHVDIRPEINRLSELKKTKHRVAAKSLVKIVKQRKTKWKGIPNSFI QIPQKARNKDADFYVASALKSGGIDIGLCGTYDKKPHADPRWTYQLYFDTEDESEKRLL YCYNDPQAKIRDFWKTFYERGNPSMVNSPGTIEFRMEGFFEKMTPISIESKDFDFRVWNK DLLIRRGLYEIKKRKNLNRKAREIKKAMGSVKRVLANMTYGKSPTDKKSIPVYRVEREK PKKPRAVRKEENELADKLENYRREDFLIRNRRKREATEIAKIIDAAEPPIRHYHTNHLRAV KRIDLSKPVARKNTSVFLKRIMQNGYRGNYCKKCIKGNIDPNKDECRLEDIKKCICCEGT QNIWAKKEKLYTGRINVLNKRIKQMKLECFNVAKAYENFYDNLAALKEGDLKVLKLKV SIPALNPEASDPEEDM |
| 113 | NASINLGKRAINLSANYDSNLVIGCKNCKFLSFNGNFPRQTNVREGCHSCDKSTYAPEVY IVKIGERKAKYDVLDSLKKFTFQSLKYQIKKSMRERSKKPKELLEFVIFANKDKAFNVIQ KSYEHLILNIKQEINRMNGKKRIKNHKKRLFKDREKQLNKLRLIGSSSLFFPRENKGDKD LFTYVAIHSVGRDIGVAGSYESHIEPISDLTYQLFINNEKRLLYKPKQNKIIELKENLW NLKKEKKPLDLEFTKPLEKSITFSVKNDKLFKVSKDLMLRQAKFNIQGKEKLSKEERQIN RDFSKIKSNVISLSYGRFEELKKEKNIWSPHIYREVKQEIKPCIVRKGDRIELFEQLKRKM DKLKKFRKERQKKISKDLNFAERIAYNFHTKSIKNTSNKINIDQEAKRGKASYMRKRIGN ESFRKKYCEQCFSVGNVYHNVQNGCSCFDNPIELIKKGDEGLIPKGKEDRKYKGALRDD NLQMQIIRVAFNIAKGYEDFYNNLKEKTEKDLKLKFKIGTTISTQESNNKEM |
| 114 | SNLIKLGKQAINFAANYDANLEVGCKNCKFLSSTNKYPRQTNVHLDNKMACRSCNQST MEPAIYIVRIGEKKAKYDIYNSLTKFNFQSLKYKAKRSQRFKPKQPKELQELSIAVRKEK ALDIIQKSIDHLIQDIRPEIPRIKQQKRYKNHVGKLFYLQKRRKNKLNLIGKGSFFKVFSPK EKKNELLVICALTNIGRDIGLIGNYNTIINPLFEVTYQLYYDYIPKKNNKNVQRRLLYAYK SKNEKILKLKEAFFKRGHENAVNLGSFSYEKPLEKSLTLKIKNDKDDFQVSPSLRIRTGRF FVPSKRNLSRQEREINRRLVKIKSKIKNMTYGKFETARDKQSVHIFRLERQKEKLPLQFRK DEKEFMEEFQKLKRRTNSLKKLRKSRQKKLADLLQLSEKVVYNNHTGTLKKTSNFLNFS SSVKRGKTAYIKELLGQEGFETLYCSNCINKGQKTRYNIETKEKCFSCKDVPFVWKKKST DKDRKGAFLFPAKLKDVIKATFTVAKAYEDFYDNLKSIDEKKPYIKFKIGLILAHVREHEH KARAKEEAGQKNIYNKPIKIDKNCKECFFFKEEAM |
| 115 | NTTRKKFRKRTGFPQSDNIKLAYCSAIVRAANLDADIQKKHNQCNPNLCVGIKSNEQSR KYEHSDRQALLCYACNQSTGAPKVDYIQIGEIGAKYKILQMVNAYDFLSLAYNLTKLRN GKSRGHQRMSQLDEVVIVADYEKATEVIKRSINHLLDDIRGQLSKLKKRTQNEHITEHKQ SKIRRKLRKLSRLLKRRRWKWGTIPNPNPYLKNWVFTKKDPELVTVALLHKLGRDIGLVNR SKRRSKQKLLPKVGFQLYYKWESPSLNNIKKSKAKKLPKRLLIPYKNVKLFDNKQKLEN AIKSLLESYQKTIKVEFDQFFQNRTEEIIAEEQQTLERGLLKQLEKKKNEFASQKKALKEE KKKIKEPRKAKLLMEESRSLGFLMANVSYALFNTTIEDLYKKSNVVSGCIPQEPVVFPA DIQNKGSLAKILFAPKDGFRIKFSGQHLTIRTAKFKIRGKEIKILTKTKREILKNIEKLRRV WYREQHYKLKLFGKEVSAKPRFLDKRKTSIERRDPNKLADQTDDRQAELRNKEYELRH |

TABLE 2-continued

Cas14 Protein Sequences

| SEQ ID NO | Sequence |
|---|---|
| | KQHKMAERLDNIDTNAQNLQTLSFWVGEADKPPKLDEKDARGFGVRTCISAWKWFME DLLKKQEEDPLLKLKLSIM |
| 116 | PKKPKFQKRTGFPQPDNLRKEYCLAIVRAANLDADFEKKCTKCEGIKTNKKGNIVKGRT YNSADKDNLLCYACNISTGAPAVDYVFVGALEAKYKILQMVKAYDFHSLAYNLAKLW KGRGRGHQRMGGLNEVVIVSNNEKALDVIEKSLNHFHDEIRGELSRLKAKFQNEHLHVH KESKLRRKLRKISRLLKRRRWKWDVIPNSYLRNFTFTKTRPDFISVALLHRVGRDIGLVT KTKIPKPTDLLPQFGFQIYYTWDEPKLNLKLKKSRLRSEPKRLLVPYKKIELYKNKSVLEE AIRHLAEVYTEDLTICFKDFFETQKRKFVSKEKESLKRELLKELTKLKKDFSERKTALKR DRKEIKEPKKAKLLMEESRSLGFLAANTSYALFNLIAADLYTKSKKACSTKLPRQLSTILP LEIKEHKSTTSLAIKPEEGFKIRFSNTHLSIRTPKFKMKGADIKALTKRKREILKNATKLEK SWYGLKHYKLKLYGKEVAAKPRFLDKRNPSIDRRDPKELMEQIENRRNEVKDLEYEIRK GQHQMAKRLDNVDTNAQNLQTKSFWVGEADKPPELDSMEAKKLGLRTCISAWKWFM KDLVLLQEKSPNLKLKLSLTEM |
| 117 | KFSKRQEGFLIPDNIDLYKCLAIVRSANLDADVQGHKSCYGVKKNGTYRVKQNGKKGV KEKGRKYVFDLIAFKGNIEKIPHEAIEEKDQGRVIVLGKFNYKLILNIEKNHNDRASLEIK NKIKKLVQISSLETGEFLSDLLSGKIGIDEVYGIIEPDVFSGKELVCKACQQSTYAPLVEYM PVGELDAKYKILSAIKGYDFLSLAYNLSRNRANKKRGHQKLGGGELSEVVISANYDKAL NVIKRSINHYHVEIKPEISKLKKKMQNEPLKVMKQARIRRELHQLSRKVKRLKWKWGMI PNPELQNIIFEKKEKDFVSYALLHTLGRDIGLFKDTSMLQVPNISDYGFQIYYSWEDPKLN SIKKIKDLPKRLLIPYKRLDFYIDTILVAKVIKNLIELYRKSYVYETFGEEYGYAKKAEDIL FDWDSINLSEGIEQKIQKIKDEFSDLLYEARESKRQNFVESFENILGLYDKNFASDRNSYQ EKIQSMIIKKQQENIEQKLKREFKEVIERGFEGMDQNKKYYKVLSPNIKGGLLYTDTNNL GFFRSHLAFMLLSKISDDLYRKNNLVSKGGNKGILDQTPETMLTLEFGKSNLPNISIKRKF FNIKYNSSWIGIRKPKFSIKGAVIREITKKVRDEQRLIKSLEGVWHKSTHFKRWGKPRFNL PRHPDREKNNDDNLMESITSRREQIQLLLREKQKQQEKMAGRLDKIDKEIQNLTANFQI KQIDKKPALTEKSEGKQSVRNALSAWKWFMEDLIKYQKRTPILQLKLAKM |
| 118 | KFSKRQEGFVIPENIGLYKCLAIVRSANLDADVQGHVSCYGVKKNGTYVLKQNGKKSIR EKGRKYASDLVAFKGDIEKIPPEVIEEKKKEQSIVLGKFNYKLVLDVMKGEKDRASLTM KNKSKKLVQVSSLGTDEFLLTLLNEKFGIEEIYGIIEPEVFSGKKLVCKACQQSTYAPLVE YMPVGELDSKYKILSAIKGYDFLSLAYNLARHRSNKKRGHQKLGGGELSEVVISANNAK ALNVIKRSLNHYYSEIKPEISLRKKMQNEPLKVGKQARMRRELHQLSRKVKRLKWKKW GKIPNLELQNITFKESDRDFISYALLHTLGRDIGMFNKTEIKMPSNILGYGFQIYYDWEEP KLNTIKSKNTPKRILIPYKKLDFYNDSILVARAIKELVGLFQESYEWEIFGNEYNYAKEA EVELIKLDEESINGNVEKKLQRIKENFSNLLEKAREKKRQNFIESFESIARLYDESFTADRN EYQREIQSFIIEKQKQSIEKKLKNEFKKIVEKKFNEQEQGKKHYRVLNPTIINEFLPKDKNN LGFLRSKIAFILLSKISDDLYKKSNAVSKGGEKGIIKQQPETILDLEFSKSKLPSINIKKKLF NIKYTSSWLGIRKPKFNIKGAKIREITRRVRDVQRTLKSAESSWYASTHFRRWGPRFNQ PRHPDKEKKSDDRLIESITLLREQIQILLREKQKGQKEMAGRLDDVDKKIQNLQTANFQI KQTGDKPALTEKSAGKQSFRNALSAWKWFMENLLLKYQNKTPDLKLKIARTVM |
| 119 | KWIEPNNIDFNKCLAITRSANLDADVQGHKMCYGIKTNGTYKAIGKINKKHNTGIIEKRR TYVYDLIVTKEKNEKIVKKTDFMAIDEEIEFDEKKEKLLLKKYIKAEVLGTGELIRKDLND GEKFDDLCSIEEPQAFRRSELVCKACNQSTYASDIRYIPIGEIEAKYKILKAIKGYDFLSLK YNLGRLRDSKKRGHQKMGQGELKEFVICANKEKALDVIKRSLNHYLNEVKDEISRLNK KMQNEPLKVNDQARWRRELNQISRRLKRLKWKWGEIPNPELKNLIFKSSRPEFVSYALI HTLGRDIGLINETELKPNNIQEYGFQIYYKWEDPELNHIKKVKNIPKRFIIPYKNLDLFGKY TILSRAIEGILKLYSSSFQYKSFKDPNLFAKEGEKKITNEDFELGYDEKIKKIKDDFKSYKK ALLEKKKNTLEDSLNSILSVYEQSLLTEQINNVKKWKEGLLKSKESIHKQKKIENIEDIISR IEELKNVEGWIRTKERDIVNKEETNLKREIKKELKDSYYEEVRKDFSDLKKGEESEKKPF REEPKPIVIKDYIKFDVLPGENSALGFFLSHLSFNLFDSIQYELFEKSRLSSSKHPQIPETILD L |
| 120 | FRKFVKRSGAPQPDNLNKYKCIAIVRAANLDADIMSNESSNCVMCKGIKMNKRKTAKG AAKTTELGRVYAGQSGNLLCTACTKSTMGPLVDYVPIGRIRAKYTILRAVKEYDFLSLA YNLARTRVSKKGGRQKMHSLSELVIAAEYEIAWNIIKSSVIHYHQETKEEISGLRKKLQA EHIHKNKEARIRREMHQISRRIKRLKWKWHMIPNSELHNFLFKQQDPSFVAVALLHTLG RDIGMINKPKGSAKREFIPEYGFQIYYKWMNPKLNDINKQKYRKMPKRSLIPYKNLNVF GDRELIENAMHKLLKLYDENLEVKGSKFFKTRVVAISSKESEKLKRDLLWKGELAKIKK DFNADKNKMQELFKEVKEPKKANALMKQSRNMGFLLQNISYGALGLLANRMYEASAK QSKGDATKQPSIVIPLEMEFGNAFPKLLLRSGKFAMNVSSPWLTIRKPKFVIKGNKIKNIT KLMKDEKAKLKRLETSYHRATHFRPTLRGSIDWDSPYFSSPKQPNTHRRSPDRLSADITE YRGRLKSVEAELREGQRAMAKKLDSVDMTASNLQTSNFQLEKGEDPRLTEIDEKGRSIR NCISSWKKFMEDLMKAQEANPVIKIKIALKDESSVLSEDSM |
| 121 | KFHPENLNKSYCLAIVRAANLDADIQGHINCIGIKSNKSDRNYENKLESLQNVELLCKAC TKSTYKPNINSVPVGEKKAKYSILSEIKKYDFNSLVYNLKYKRGKSRGHQKLNELRELV ITSEYKKALDVINKSVNHYLVNIKNKMSLKKKILQNEHIHVGTLARIRRERNRISRKLDH YRKKWKFVPNKILKNYVFKNQSPDFVSVALLHKLGRDIGLITKTAILQKSFPEYSLQLYY KYDTPKLNYLKKSKFKSLPKRILISYKYPKFDINSNYIEESIDKLLKLYEESPIYKNNSKIIE FFKKSEDNLIKSENDSLKRGIMKEFEKVTKNFSSKKKKLKEELKLKNEDKNSKMLAKVS RPIGFLKAYLSYMLFNIISNRIFEFSRKSSGRIPQLPSCHNLGNQFENFKNELQDSNIGSKKN |

TABLE 2-continued

Cas14 Protein Sequences

| SEQ ID NO | Sequence |
|---|---|
| | YKYFCNLLLKSSGFNISYEEEHLSIKTPNFFINGRKLKEITSEKKKIRKENEQLIKQWKKLT FFKPSNLNGKKTSDKIRFKSPNNPDIERKSEDNIVENIAKVKYKLEDLLSEQRKEFNKLAK KHDGVDVEAQCLQTKSFWIDSNSPIKKSLEKKNEKVSVKKKMKAIRSCISAWKWFMAD LIEAQKETPMIKLKLALM |
| 122 | TTLVPSHLAGIEVMDETTSRNEDMIQKETSRSNEDENYLGVKNKCGINVHKSGRGSSKH EPNMPPEKSGEGQMPKQDSTEMQQRFDESVTGETQVSAGATASIKTDARANSGPRVGT ARALIVKASNLDRDIKLGCKPCEYIRSELPMGKKNGCNHCEKSSDIASVPKVESGFRKAK YELVRRFESFAADSISRHLGKEQARTRGKRGKKDKKEQMGKVNLDEIAILKNESLIEYTE NQILDARSNRIKEWLRSLRLRLRTRNKGLKKSKSIRRQLITLRRDYRKWIKPNPYRPDEDP NENSLRLHTKLGVDIGVQGGDNKRMNSDDYETSFSITWRDTATRKICFTKPKGLLPRHM KFKLRGYPELILYNEELRIQDSQKFPLVDWERIPIFKLRGVSLGKKKVKALNRITEAPRLV VAKRIQVNIESKKKKVLTRYVYNDKSINGRLVKAEDSNKDPLLEFKKQAEEINSDAKYY ENQEIAKNYLWGCEGLHKNLLEEQTKNPYLAFKYGFLNIV |
| 123 | LDFKRTCSQELVLLPEIEGLKLSGTQGVTSLAKKLINKAANVDRDESYGCHHCIHTRTSL SKPVKKDCNSCNQSTNHPAVPITLKGYKIAFYELWHRFTSWAVDSISKALHRNKVMGK VNLDEYAVVDNSHIVCYAVRKCYEKRQRSVRLHKRAYRCRAKHYNKSQPKVGRIYKK SKRRNARNLKKEAKRYFQPNEITNGSSDALFYKIGVDLGIAKGTPETEVKVDVSICFQVY YGDARRVLRVRKMDELQSFHLDYTGKLKLKGIGNKDTFTIAKRNESLKWGSTKYEVSR AHKKFKPFGKKGSVKRKCNDYFRSIASWSCEAASQRAQSNLKNAFFPYQKALVKCYKNL DYKGVKKNDMWYRLCSNRIFRYSRIAEDIAQYQSDKGKAKFEFVILAQSVAEYDISAIM |
| 124 | VFLTDDKRKTALRKIRSAFRKTAEIALVRAQEADSLDRQAKKLTIETVSFGAPGAKNAFI GSLQGYNWNSHRANVPSSGSAKDVFRITELGLGIPQSAHEASIGKSFELVGNVVRYTANL LSKGYKKGAVNKGAKQQREIKGKEQLSFDLISNGPISGDKLINGQKDALAWWLIDKMGF HIGLAMEPLSSPNTYGITLQAFWKRHTAPRRYSRGVIRQWQLPFGRQLAPLIHNFFRKKG ASIPIVLTNASKKLAGKGVLLEQTALVDPKKWWQVKEQVTGPLSNIWERSVPLVLYTAT FTHKHGAAHKRPLTLKVIRISSGSVFLLPLSKVTPGKLVRAWMPDINILRDGRPDEAAYK GPDLIRARERSFPLAYTCVTQIADEWQKRALESNRDSITPLEAKLVTGSDLLQIHSTVQQA VEQGIGGRISSPIQELLAKDALQLVLQQLFMTVDLLRIQWQLKQEVADGNTSEKAVGWA IRISNIHKDAYKTAIEPCTSALKQAWNPLSGFEERTFQLDASIVRKRSTAKTPDDELVIVLR QQAAEMTVAVTQSVSKELMELAVRHSATLHLLVGEVASKQLSRSADKDRGAMDHWKL LSQSM |
| 125 | EDLLQKALNTATNVAAIERHSCISCLFTESEIDVKYKTPDKIGQNTAGCQSCTFRVGYSG NSHTLPMGNRIALDKLRETIQRYAWHSLLFNVPPAPTSKRVRAISELRVAAGRERLFTVIT FVQTNILSKLQKRYAANWTPKSQERLSRLREEGQHILSLLESGSWQQKEVVREDQDLIVC SALTKPGLSIGAFCRPKYLKPAKHALVLRLIFVEQWPGQIWGQSKRTRRMRRRKDVERV YDISVQAWALKGKETRISECIDTMRRHQQAYIGVLPFLILSGSTVRGKGDCPILKEITRMR YCPNNEGLIPLGIFYRGSANKLLRVVKGSSFTLPMWQNIETLPHPEPFSPEGWTATGALY EKNLAYWSALNEAVDWYTGQILSSGLQYPNQNEFLARLQNVIDSIPRKWFRPQGLKNLK PNGQEDIVPNEFVIPQNAIRAHHVIEWYHKTNDLVAKTLLGWGSQTTLNQTRPQGDLRF TYTRYYFREKEVPEV |
| 126 | VPKKKLMRELAKKAVFEAIFNDPIPGSFGCKRCTLIDGARVTDAIEKKQGAKRCAGCEPC TFHTLYDSVKHALPAATGCDRTAIDTGLWEILTALRSYNWMSFRRNAVSDASQKQVWSI EELAIWADKERALRVILSALTHTIGKLKNGFSRDGVWKGGKQLYENLAQKDLAKGLFA NGEIFGKELVEADHDMLAWTIVPNHQFHIGLIRGNWKPAAVEASTAFDARWLTNGAPL RDTRTHGHRGRRFNRTEKLTVLCIKRDGGVSEEFRQERDYELSVMLLQPKNKLKPEPKG ELNSFEDLHDHWWFLKGDEATALVGLTSDPTVGDFIQLGLYIRNPIKAHGETKRRLLICF EPPIKLPLRRAFPSEAFKTWEPTINVFRNGRRDTEAYYDIDRARVFEFPETRVSLEHLSKQ WEVLRLEPDRENTDPYEAQQNEGAELQVYSLLQEAAQKMAPKVVIDPFGQFPLELFSTF VAQLFNAPLSDTKAKIGKPLDSGFVVESHLHLLEEDFAYRDFVRVTFMGTEPTFRVIHYS NGEGYWKKTVLKGKNNIRTALIPEGAKAAVDAYKNKRCPLTLEAAILNEEKDRRLVLG NKALSLLAQTARGNLTILEALAAEVLRPLSGTEGVVHLHACVTRHSTLTESTETDNM |
| 127 | VEKLFSERLKRAMWLKNEAGRAPPAETLTLKHKRVSGGHEKVKEELQRVLRSLSGTNQ AAWNLGLSGGREPKSSDALKGEKSRVVLETVVFHSGHNRVLYDVIEREDQVHQRSSIM HMRRKGSNLLRLWGRSGKVRRKMREEVAEIKPVWHKDSRWLAIVEEGRQSVVGISSAG LAVFAVQESQCTTAEPKPLEYVVSIWFRGSKALNPQDRYLEFKKLKTTEALRGQQYDPIP FSLKRGAGCSLAIRGEGIKFGSRGPIKQFFGSDRSRPSHADYDGKRRLSLFSKYAGDLADL TEEQWNRTVSAFAEDEVRRATLANIQDFLSISHEKYAERLKKRIESIEEPVSASKLEAYLS AIFETFVQQREALASNFLMRLVESVALLISLEEKSPRVEFRVARYLAESKEGFNRKAM |
| 128 | VVITQSELYKERLLRVMEIKNDRGRKEPRESQGLVLRFTQVTGGQEKVKQKLWLIFEGFS GTNQASWNFGQPAGGRKPNSGDALKGPKSRVTYETVVFHFGLRLLSAVIERHNLKQQR QTMAYMKRRAAARKKWARSGKKCSRMRNEVEKIKPKWHKDPRWFDIVKEGEPSIVGIS SAGFAIYIVEEPNFPRQDPLEIEYAISIWFRRDSQYLTFKKIQKAEKLKELQYNPIPFRLK QEKTSLVFESGDIKFGSRGSIEHFRDEARGKPPKADMDNNRRLTMFSVFSGNLTNLTEEQ YARPVSGLLAPDEKRMPTLLKKLQDFFTPIHEKYGERIKQRLANSEASKRPFKKLEEYLP AIYLEFRARREGLASNWVLVLINSVRTLVRIKSEDPYIEFKVSQYLLEKEDNKAL |

TABLE 2-continued

Cas14 Protein Sequences

| SEQ ID NO | Sequence |
|---|---|
| 129 | KQDALFEERLKKAIFIKRQADPLQREELSLLPPNRKIVTGGHESAKDTLKQILRAINGTNQ ASWNPGTPSGKRDSKSADALAGPKSRVKLETVVFHVGHRLLKKVVEYQGHQKQQHGL KAFMRTCAAMRKKWKRSGKVVGELREQLANIQPKWHYDSRPLNLCFEGKPSVVGLRS AGIALYTIQKSVVPVKEPKPIEYAVSIWFRGPKAMDREDRCLEFKKLKIATELRKLQFEPI VSTLTQGIKGFSLYIQGNSVKFGSRGPIKYFSNESVRQRPPKADPDGNKRLALFSKFSGDL SDLTEEQWNRPILAFEGIIRRATLGNIQDYLTVGHEQFAISLEQLLSEKESVLQMSIEQQRL KKNLGKKAENEWVESFGAEQARKKAQGIREYISGFFQEYCSQREQWAENWVQQLNKS VRLFLTIQDSTPFIEFRVARYLPKGEKKKGKAM |
| 130 | ANHAERHKRLRKEANRAANRNRPLVADCDTGDPLVGICRLLRRGDKMQPNKTGCRSCE QVEPELRDAILVSGPGRLDNYKYELFQRGRAMAVHRLLKRVPKLNRPKKAAGNDEKKA ENKKSEIQKEKQKQRRMMPAVSMKQVSVADFKHVIENTVRHLFGDRRDREIAECAALR AASKYFLKSRRVRPRKLPKLANPDHGKELKGLRLREKRAKLKKEKEKQAELARSNQKG AVLHVATLKKDAPPMPYEKTQGRNDYTTFVISAAIKVGATRGTKPLLTPQPREWQCSLY WRDGQRWIRGGLLGLQAGIVLGPKLNRELLEAVLQRPIECRMSGCGNPLQVRGAAVDF FMTTNPFYVSGAAYAQKKFKPFGTKRASEDGAAAKAREKLMTQLAKVLDKVVTQAAH SPLDGIWETRPEAKLRAMIMALEHEWIFLRPGPCHNAAEEVIKCDCTGGHAILWALIDEA RGALEHKEFYAVTRAHTHDCEKQKLGGRLAGFLDLLIAQDVPLDDAPAARKIKTLLEAT PPAPCYKAATSIATCDCEGKFDKLWAIIDATRAGHGTEDLWARTLAYPQNVNCKCKAG KDLTHRLADFLGLLIKRDGPFRERPPHKVTGDRKLVFSGDKKCKGHQYVILAKAHNEEV VRAWISRWGLKSRTNKAGYAATELNLLLNWLSICRRRWMDMLTVQRDTPYIRMKTGR LVVDDKKERKAM |
| 131 | AKQREALRVALERGIVRASNRTYTLVTNCTKGGPLPEQCRMIERGKARAMKWEPKLVG CGSCAAATVDLPAIEEYAQPGRLDVAKYKLTTQILAMATRRMMVRAAKLSRRKGQWP AKVQEEKEEPPEPKKMLKAVEMRPVAIVDFNRVIQTTIEHLWAERANADEAELKALKA AAAYFGPSLKIRARGPPKAAIGRELKKAHRKKAYAERKKARRKRAELARSQARGAAAH AAIRERDIPPMAYERTQGRNDVTTIPIAAAIKIAATRGARPLPAPKPMKWQCSLYWNEGQ RWIRGGMLTAQAYAHAANIHRPMRCEMWGVGNPLKVRAFEGRVADPDGAKGRKAEF RLQTNAFYVSGAAYRNKKFKPFGTDRGGIGSARKKRERLMAQLAKILDKVVSQAAHSP LDDIWHTRPAQKLRAMIKQLEHEWMFLRPQAPTVEGTKPDVDVAGNMQRQIKALMAP DLPPIEKGSPAKRFTGDKRKKGERAVRVAEAHSDEVVTAWISRWGIQTRRNEGSYAAQE LELLLNWLQICRRRWLDMTAAQRVSPYIRMKSGRMITDAADEGVAPIPLVENM |
| 132 | KSISGRSIKHMACLKDMLKSEITEIEEKQKKESLRKWDYYSKFSDEILFRRNLNVSANHD ANACYGCNPCAFLKEVYGFRIERRNNERIISYRRGLAGCKSCVQSTGYPPIEFVRRKFGA DKAMEIVREVLHRRNWGALARNIGREKEADPILGELNELLLVDARPYFGNKSAANETNL AFNVITRAAKKFRDEGMYDIHKQLDIHSEEGKVPKGRKSRLIRIERKHKAIHGLDPGETW RYPHCGKGEKYGVWLNRSRLIHIKGNEYRCLTAFGTTGRRMSLDVACSVLGHPLVKKK RKKGKKTVDGTELWQIKKATETLPEDPIDCTFYLYAAKPTKDPFILKVGSLKAPRWKKL HKDFFEYSDTEKTQGQEKGKRVVRRGKVPRILSLRPDAKFKVSIWDDPYNGKNKEGTLL RMELSGLDGAKKPLILKRYGEPNTKPKNFVFWRPHITPHPLTFTPKHDFGDPNKKTKRRR VFNREYYGHLNDLAKMEPNAKFFEDREVSNKKNPKAKNIRIQAKESLPNIVAKNGRWA AFDPNDSLWKLYLHWRGRRKTIKGGISQEFQEFKERLDLYKKHEDESEWKEKEKLWEN HEKEWKKTLEIHGSIAEVSQRCVMQSMMGPLDGLVQKKDYVHIGQSSLKAADDAWTFS ANRYKKATGPKWGKISVSNLLYDANQANAELISQSISKYLSKQKDNQGCEGRKMKFLIK IIEPLRENFVKHTRWLHEMTQKDCEVRAQFSRVSM |
| 133 | FPSDVGADALKHVRMLQPRLTDEVRKVALTRAPSDRPALARFAAVAQDGLAFVRHLNV SANHDSNCTFPRDPRDPRRGPCEPNPCAFLREVWGFRIVARGNERALSYRRGLAGCKSC VQSTGFPSVPFHRIGADDCMRKLHEILKARNWRLLARNIGREREADPLLTELSEYLLVDA RTYPDGAAPNSGRLAENVIKRAAKKFRDEGMRDIHAQLRVHSREGKVPKGRLQRLRIE RKHRAIHALDPGPSWEAEGSARAEVQGVAVYRSQLLRVGHHTQQIEPVGIVARTLFGVG RTDLDVAVSVLGAPLTKRKKGSKTLESTEDFRIAKARETRAEDKIEVAFVLYPTASLLRD EIPKDAFPAMRIDRFLLKVGSVQADREILLQDDYYRFGDAEVKAGKNKGRTVTRPVKVP RLQALRPDAKFRVNVWADPFGAGDSPGTLLRLEVSGVTRRSQPLRLLRYGQPSTQPANF LCWRPHRVPDPMTFTPRQKFGERRKNRRTRRPRVFERLYQVHIKHLAHLEPNRKWFEEA RVSAQKWAKARAIRRKGAEDIPVVAPPAKRRWAALQPNAELWDLYAHDREARKRFRG GRAAEGEEFKPRLNLYLAHEPEAEWESKRDRWERYEKKWTAVLEEHSRMCAVADRTL PQFLSDPLGARMDDKDYAFVGKSALAVAEAFVEEGTVERAQGNCSITAKKKFASNASR KRLSVANLLDVSDKADRALVFQAVRQYVQRQAENGGVEGRRMAFLRKLLAPLRQNFV CHTRWLHM |
| 134 | AARKKKRGKIGITVKAKEKSPPAAGPFMARKLVNVAANVDGVEVHLCVECEADAHGS ASARLLGGCRSCTGSIGAEGRLMGSVDVDRERVIAEPVHTETERLGPDVKAFEAGTAES KYAIQRGLEYWGVDLISRNRARTVRKMEEADRPESSTMEKTSWDEIAIKTYSQAYHASE NHLFWERQRRVVRQHALALFRRARERNRGESPLQSTQRPAPLVLAALHAEAAAISGRARA EYVLRGPSANVRAAAADIDAKPLGHYKTPSPKVARGFPVKRDLLRARHRIVGLSRAYFK PSDVVRGTSDAIAHVAGRNIGVAGGKPKEIEKTFTLPFVAYWEDVDRVVHCSSFKADGP WVRDQRIKIRGVSSAVGTFSLYGLDVAWSKPTSFYIRCSDIRKKFHPKGFGPMKHWRQW AKELDRLTEQRASCVVRALQDDEELLQTMERGQRYYDVFSCAATHATRGEADPSGGCS RCELVSCGVAHKVTKKAKGDTGIEAVAVAGCSLCESKLVGPSKPRVHRQMAALRQSHA LNYLRRLQREWEALEAVQAPTPYLRFKYARHLEVRSM |

TABLE 2-continued

Cas14 Protein Sequences

| SEQ ID NO | Sequence |
|---|---|
| 135 | AAKKKKQRGKIGISVKPKEGSAPPADGPFMARKLVNVAANVDGVEVNLCIECEADAHG SAPARLLGGCKSCTGSIGAEGRLMGSVDVDRADAIAKPVNTETEKLGPDVQAFEAGTAE TKYALQRGLEYWGVDLISRNRSRTVRRTEEGQPESATMEKTSWDEIAIKSYTRAYHASE NHLFWERQRRVRQHALALFKRAKERNRGDSTLPREPGHGLVAIAALACEAYAVGGRNL AETVVRGPTFGTARAVRDVEIASLGRYKTPSPKVAHGSPVKRDFLRARHRIVGLARAYY RPSDVVRGTSDAIAHVAGRNIGVAGGKPRAVEAVFTLPFVAYWEDVDRVVHCSSFQVS APWNRDQRMKIAGVTTAAGTFSLHGGELKWAKPTSFYIRCSDTRRKFRPKGFGPMKRW RQWAKDLDRLVEQRASCVVRALQDDAALLETMERGQRYYDVFACAVTHATRGEADR LAGCSRCALTPCQEAHRVTTKPRGDAGVEQVQTSDCSLCEGKLVGPSKPRLHRTLTLLR QEHGLNYLRRLQREWESLEAVQVPTPYLRFKYARHLEVRSM |
| 136 | TDSQSESVPEVVYALTGGEVPGRVPPDGGSAEGARNAPTGLRKQRGKIKISAKPSKPGSP ASSLARTLVNEAANVDGVQSSGCATCRMRANGSAPRALPIGCVACASSIGRAPQEETVC ALPTTQGPDVRLLEGGHALRKYDIQRALEYWGVDLIGRNLDRQAGRGMEPAEGATATM KRVSMDELAVLDFGKSYYASEQHLFAARQRRVRQHAKALKIRAKHANRSGSVKRALD RSRKQVTALAREFFKPSDVVRGDSDALAHVVGRNLGVSRHPAREIPQTFTLPLCAYWED VDRVISCSSLLAGEPFARDQEIRIEGVSSALGSLRLYRGAIEWHKPTSLYIRCSDTRRKFRP RGGLKKRWRQWAKDLDRLVEQRACCIVRSLQADVELLQTMERAQRFYDVHDCAATH VGPVAVRCSPCAGKQFDWDRYRLLAALRQEHALNYLRRLQREWESLEAQQVKMPYLR FKYARKLEVSGPLIGLEVRREPSMGTAIAEM |
| 137 | AGTAGRRHGSLGARRSINIAGVTDRHGRWGCESCVYTRDQAGNRARCAPCDQSTYAPD VQEVTIGQRQAKYTIFLTLQSFSWTNTMRNNKRAAAGRSKRTTGKRIGQLAEIKITGVGL AHAHNVIQRSLQHNITKMWRAEKGKSKRVARLKKAKQLTKRRAYFRRRMSRQSRGNG FFRTGKGGIHAVAPVKIGLDVGMIASGSSEPADEQTVTLDAIWKGRKKKIRLIGAKGELA VAACRFREQQTKGDKCIPLILQDGEVRWNQNNWQCHPKKLVPLCGLEVSRKFVSQADR LAQNKVASPLAARFDKTSVKGTLVESDFAAVLVNVTSIYQQCHAMLLRSQEPTPSLRVQ RTITSM |
| 138 | GVRFSPAQSQVFFRTVIPQSVEARFAINMAAIHDAAGAFGCSVCRFEDRTPRNAKAVHG CSPCTRSTNRPDVFVLPVGAIKAKYDVFMRLLGFNWTHLNRRQAKRVTVRDRIGQLDEL AISMLTGKAKAVLKKSICHNVDKSFKAMRGSLKKLHRKASKTGKSQLRAKLSDLRERT NTTQEGSHVEGDSDVALNKIGLDVGLVGKPDYPSEESVEVVVCLYFVGKVLILDAQGRI RDMRAKQYDGFKIPIIQRGQLTVLSVKDLGKWSLVRQDYVLAGDLRFEPKISKDRKYAE CVKRIALITLQASLGFKERIPYYVTKQVEIKNASHIAFVTEAIQNCAENFREMTEYLMKY QEKSPDLKVLLTQLM |
| 139 | RAVVGKVFLEQARRALNLATNFGTNHRTGCNGCYVTPGKLSIPQDGEKNAAGCTSCLM KATASYVSYPKPLGEKVAKYSTLDALKGFPWYSLRLNLRPNYRGKPINGVQEVAPVSKF RLAEEVIQAVQRYHFTELEQSFPGGRRRLRELRAFYTKEYRRAPEQRQHVVNGDRNIVV VTVLHELGFSVGMFNEVELLPKTPIECAVNVFIRGNRVLLEVRKPQFDKERLLVESLWKK DSRRHTAKWTPPNNEGRIFTAEGWKDFQLPLLLGSTSRSLRAIEKEGFVQLAPGRDPDYN NTIDEQHSGRPFLPLYLYLQGTISQEYCVFAGTWVIPFQDGISPYSTKDTFQPDLKRKAYS LLLDAVKHRLGNKVASGLQYGRFPAIEELKRLVRMHGATRKIPRGEKDLLKKGDPDTPE WWLLEQYPEFWRLCDAAAKRVSQNVGLLLSLKKQPLWQRRWLESRTRNEPLDNLPLS MALTLHLTNEEAL |
| 140 | AAVYSKFYIENHFKMGIPETLSRIRGPSIIQGFSVNENYINIAGVGDRDFIFGCKKCKYTRG KPSSKKINKCHPCKRSTYPEPVIDVRGSISEFKYKIYNKLKQEPNQSIKQNTKGRMNPSDH TSSNDGIIINGIDNRIAYNVIFSSYKHLMEKQINLLRDTTKRKARQIKKYNNSGKKKHSLR SQTKGNLKNRYHMLGMFKKGSLTITNEGDFITAVRKVGLDISLYKNESLNKQEVETELC LNIKWGRTKSYTVSGYIPLPINIDWKLYLFEKETGLTLRLFGNKYKIQSKKFLIAQLFKPK RPPCADPVVKKAQKWSALNAHVQQMAGLFSDSHLLKRELKNRMHKQLDFKSLWVGTE DYIKWFEELSRSYVEGAEKSLEFFRQDYFCFNYTKQTTM |
| 141 | PQQQRDLMLMAANYDQDYGNGCGPCTVVASAAYRPDPQAHGCKRHLRTLGASAVT HVGLGDRTATITALHRLRGPAALAARARAAQAASAPMTPDTDAPDDRRRLEAIDADDV VLVGAHRALWSAVRRWADDRRAALRRRLHSEREWLLKDQIRWAELYTLIEASGTPPQG RWRNTLGALRGQSRWRRVLAPTMRATCAETHAELWDALAELVPEMAKDRRGLLRPPV EADALWRAPMIVEGWRGGHSVVVDAVAPPLDLPQPCAWTAVRLSGDPRQRWGLHLAV PPLGQVQPPDPLKATLAVSMRHRGGVRVRTLQAMAVDADAPMQRHLQVPLTLQRGGG LQWGIHSRGVRRREARSMASWEGPPIWTGLQLVNRWKGQGSALLAPDRPPDTPPYAPD AAVAPAQPDTKRARRTLKEACTVCRCAPGHMRQLQVTLTGDGTWRRFRLRAPQGAKR KAEVLKVATQHDERIANYTAWYLKRPEHAAGCDTCDGDSRLDGACRGCRPLLVGDQC FRRYLDKIEADRDDGLAQIKPKAQEAVAAMAAKRDARAQKVAARAAKLSEATGQRTA ATRDASHEARAQKELEAVATEGTTVRHDAAAVSAFGSWVARKGDEYRHQVGVLANRL EHGLRLQELMAPDSVVADQQRASGHARVGYRYVLTAM |

TABLE 2-continued

Cas14 Protein Sequences

| SEQ ID NO | Sequence |
|---|---|
| 142 | AVAHPVGRGNAGSPGARGPEELPRQLVNRASNVTRPATYGCAPCRHVRLSIPKPVLTGC<br>RACEQTTHPAPKRAVRGGADAAKYDLAAFFAGWAADLEGRNRRRQVHAPLDPQPDPN<br>HEPAVTLQKIDLAEVSIEEFQRVLARSVKHRHDGRASREREKARAYAQVAKKRRNSHA<br>HGARTRRAVRRQTRAVRRAHRMGANSGEILVASGAEDPVPEAIDHAAQLRRRIRACAR<br>DLEGLRHLSRRYLKTLEKPCRRPRAPDLGRARCHALVESLQAAERELEELRRCDSPDTA<br>MRRLDAVLAAAASTDATFATGWTVVGMDLGVAPRGSAAPEVSPMEMAISVFWRKGSR<br>RVIVSKPIAGMPIRRHELIRLEGLGTLRLDGNHYTGAGVTKGRGLSEGTEPDFREKSPSTL<br>GFTLSDYRHESRWRPYGAKQGKTARQFFAAMSRELRALVEHQVLAPMGPPLLEAHERR<br>FETLLKGQDNKSIHAGGGGRYVWRGPPDSKKRPAADGDWFRFGRGHADHRGWANKR<br>HELAANYLQSAFRLWSTLAEAQEPTPYARYKYTRVTM |
| 143 | WDFLTLQVYERHTSPEVCVAGNSTKCASGTRKSDHTHGVGVKLGAQEINVSANDDRDH<br>EVGCNICVISRVSLDIKGWRYGCESCVQSTPEWRSIVRFDRNHKEAKGECLSRFEYWGA<br>QSIARSLKRNKLMGGVNLDELAIVQNENVVKTSLKHLFDKRKDRIQANLKAVKVRMRE<br>RRKSGRQRKALRRQCRKLKRYLRSYDPSDIKEGNSCSAFTKLGLDIGISPNKPPKIEPKVE<br>VVFSLFYQGACDKIVTVSSPESPLPRSWKIKIDGIRALYVKSTKVKFGGRTFRAGQRNNR<br>RKVRPPNVKKGKRKGSRSQFFNKFAVGLDAVSQQLPIASVQGLWGRAETKKAQTICLK<br>QLESNKPLKESQRCLFLADNWVVRVCGFLRALSQRQGPTPYIRYRYRCNM |
| 144 | ARNVGQRNASRQSKRESAKARSRRVTGGHASVTQGVALINAAANADRDHTTGCEPCT<br>WERVNLPLQEVIHGCDSCTKSSPFWRDIKVVNKGYREAKEEIMRIASGISADHLSRALSH<br>NKVMGRLNLDEVCILDFRTVLDTSLKHLTDSRSNGIKEHIRAVHRKIRMRRKSGKTARA<br>LRKQYFALRRQWKAGHKPNSIREGNSLTALRAVGFDVGVSEGTEPMPAPQTEVVLSVFY<br>KGSATRILRISSPHPIAKRSWKVKIAGIKALKLIRREHDFSFGRETYNASQRAEKRKFSPHA<br>ARKDFFNSFAVQLDRLAQQLCVSSVENLWVTEPQQKLLTLAKDTAPYGIREGARFADTR<br>ARLAWNWVFRVCGFTRALHQEQEPTPYCRFTWRSKM |

In some embodiments, the Type VI CRISPR/Cas enzyme is a programmable Cas13 nuclease. The general architecture of a Cas13 protein includes an N-terminal domain and two HEPN (higher eukaryotes and prokaryotes nucleotide-binding) domains separated by two helical domains (Liu et al., Cell 2017 Jan. 12; 168 (1-2): 121-134.e12). The HEPN domains each comprise aR-$X_4$—H motif. Shared features across Cas13 proteins include that upon binding of the crRNA of the guide nucleic acid to a target nucleic acid, the protein undergoes a conformational change to bring together the HEPN domains and form a catalytically active RNase. (Tambe et al., Cell Rep. 2018 Jul. 24; 24(4): 1025-1036). Thus, two activatable HEPN domains are characteristic of a programmable Cas13 nuclease of the present disclosure. However, programmable Cas13 nucleases also consistent with the present disclosure include Cas13 nucleases comprising mutations in the HEPN domain that enhance the Cas13 proteins cleavage efficiency or mutations that catalytically inactivate the HEPN domains.

A programmable Cas13 nuclease can be a Cas13a protein (also referred to as "c2c2"), a Cas13b protein, a Cas13c protein, a Cas13d protein, or a Cas13e protein. Example C2c2 proteins are set forth as SEQ ID NO: 47-SEQ ID NO: 52. In some cases, a subject C2c2 protein includes an amino acid sequence having 80% or more (e.g., 85% or more, 90% or more, 95% or more, 98% or more, 99% or more, 99.5% or more, or 100%) amino acid sequence identity with the amino acid sequence set forth in any one of SEQ ID NOs: 47-SEQ ID NO: 52. In some cases, a suitable C2c2 polypeptide comprises an amino acid sequence having at least 80%, at least 85%, at least 90%, at least 95%, at least 98%, at least 99%, or 100%, amino acid sequence identity to the *Listeria seeligeri* C2c2 amino acid sequence set forth in SEQ ID NO: 47. In some cases, a suitable C2c2 polypeptide comprises an amino acid sequence having at least 80%, at least 85%, at least 90%, at least 95%, at least 98%, at least 99%, or 100%, amino acid sequence identity to the *Leptotrichia buccalis* C2c2 amino acid sequence set forth in SEQ ID NO: 48. In some cases, a suitable C2c2 polypeptide comprises an amino acid sequence having at least 80%, at least 85%, at least 90%, at least 95%, at least 98%, at least 99%, or 100%, amino acid sequence identity to the *Rhodobacter capsulatus* C2c2 amino acid sequence set forth in SEQ ID NO: 50. In some cases, a suitable C2c2 polypeptide comprises an amino acid sequence having at least 80%, at least 85%, at least 90%, at least 95%, at least 98%, at least 99%, or 100%, amino acid sequence identity to the *Carnobacterium gallinarum* C2c2 amino acid sequence set forth in SEQ ID NO: 51. In some cases, a suitable C2c2 polypeptide comprises an amino acid sequence having at least 80%, at least 85%, at least 90%, at least 95%, at least 98%, at least 99%, or 100%, amino acid sequence identity to the *Herbinix hemicellulosilytica* C2c2 amino acid sequence set forth in SEQ ID NO: 52. In some cases, the C2c2 protein includes an amino acid sequence having 80% or more amino acid sequence identity with the *Leptotrichia buccalis* (Lbu) C2c2 amino acid sequence set forth in SEQ ID NO: 48. In some cases, the C2c2 protein is a *Leptotrichia buccalis* (Lbu) C2c2 protein (e.g., see SEQ ID NO: 48). In some cases, the C2c2 protein includes the amino acid sequence set forth in any one of SEQ ID NOs: 47-48 and SEQ ID NOs: 50-52. In some cases, a C2c2 protein used in a method of the present disclosure is not a *Leptotrichia shahii* (Lsh) C2c2 protein. In some cases, a C2c2 protein used in a method of the present disclosure is not a C2c2 polypeptide having at least 80%, at least 85%, at least 90%, at least 95%, at least 98%, at least 99%, or 100%, amino acid sequence identity to the Lsh C2c2 polypeptide set forth in SEQ ID NO: 49. Cas13 protein sequences are set forth in SEQ ID NO: 47-SEQ ID NO: 52 and SEQ ID NO: 156-SEQ ID NO: 167.

TABLE 3

Cas13 Protein Sequences

| SEQ ID NO | Description | Sequence |
|---|---|---|
| 47 | *Listeria seeligeri* C2c2 amino acid sequence | MWISIKTLIHHLGVLFFCDYMYNRREKKIIEVKTMRITKVEVDRKKV LISRDKNGGKLVYENEMQDNTEQIMHHKKSSFYKSVVNKTICRPEQ KQMKKLVHGLLQENSQEKIKVSDVTKLNISNFLNHRFKKSLYYPFE NSPDKSEEYRIEINLSQLLEDSLKKQQGTFICWESFSKDMELYINWA ENYISSKTKLIKKSIRNNRIQSTESRSGQLMDRYMKDILNKNKPFDIQ SVSEKYQLEKLTSALKATFKEAKKNDKEINYKLKSTLQNHERQIIEE LKENSELNQFNIEIRKHLETYFPIKKTNRKVGDIRNLEIGEIQKIVNHR LKNKIVQRILQEGKLASYEIESTVNSNSLQKIKIEEAFALKFINACLFA SNNLRNMVYPVCKKDILMIGEFKNSFKEIKHKKFIRQWSQFFSQEIT VDDIELASWGLRGAIAPIRNEIIHLKKHSWKKFFNNPTFKVKKSKIIN GKTKDVTSEFLYKETLFKDYFYSELDSVPELIINKMESSKILDYYSSD QLNQVFTIPNFELSLLTSAVPFAPSFKRVYLKGFDYQNQDEAQPDYN LKLNIYNEKAFNSEAFQAQYSLFKMVYYQVFLPQFTTNNDLFKSSV DFILTLNKERKGYAKAFQDIRKMNKDEKPSEYMSYIQSQLMLYQKK QEEEKEKINHFEKFINQVFIKGFNSFIEKNRLTYICHPTKNTVPENDNIE IPFHTDMDDSNIAFWLMCKLLDAKQLSELRNEMIKFSCSLQSTEEIST FTKAREVIGLALLNGEKGCNDWKELFDDKEAWKKNMSLYVSEELL QSLPYTQEDGQTPVINRSIDLVKKYGTETILEKLFSSSDDYKVSAKDI AKLHEYDVTEKIAQQESLHKQWIEKPGLARDSAWTKKYQNVINDIS NYQWAKTKVELTQVRHLQLTIDLLSRLAGYMSIADRDFQFSSNYI LERENSEYRVTSWILLSENKNKNKYNDYELYNLKNASIKVSSKNDP QLKVDLKQLRLTLEYLELFDNRLKEKRNNISHFNYLNGQLGNSILEL FDDARDVLSYDRKLKNAVSKSLKEILSSHGMEVTFKPLYQTNHHLK IDKLQPKKIHHLGEKSTVSSNQVSNEYCQLVRTLLTMK |
| 48 | *Leptotrichia buccalis* (Lbu) C2c2 amino acid sequence | MKVTKVGGISHKKYTSEGRLVKSESEENRTDERLSALLNMRLDMYI KNPSSTETKENQKRIGKLKKFFSNKMVYLKDNTLSLKNGKKENIDR EYSETDILESDVRDKKNFAVLKKIYLNENVNSEELEVFRNDIKKKLN KINSLKYSFEKNKANYQKINENNIEKVEGKSKRNIIYDYYRESAKRD AYVSNVKEAFDKLYKEEDIAKLVLEIENLTKLEKYKIREFYHEIIGRK NDKENFAKIIYEEIQNVNNMKELIEKVPDMSELKKSQVFYKYYLDK EELNDKNIKYAFCHFVEIEMSQLLKNYVYKRLSNISNDKIKRIFEYQ NLKKLIENKLLNKLDTYVRNCGKYNYYLQDGEIATSDFIARNRQNE AFLRNIIGVSSVAYFSLRNILETENENDITGRMRGKTVKNNKGEEKY VSGEVDKIYNENKKNEVKENLKMFYSYDFNMDNKNEIEDFFANIDE AISSIRHGIVHFNLELEGKDIFAFKNIAPSEISKKMFQNEINEKKLKLK IFRQLNSANVFRYLEKYKILNYLKRTRFEFVNKNIPFVPSFTKLYSRI DDLKNSLGIYWKTPKTNDDNKTKEIIDAQIYLLKNIYYGEFLNYFMS NNGNFFEISKEIIELNKNDKRNLKTGFYKLQKFEDIQEKIPKEYLANI QSLYMINAGNQDEEEKDTYIDFIQKIFLKGFMTYLANNGRLSLIYIGS DEETNTSLAEKKQEFDKFLKKYEQNNNIKIPYEINEFLREIKLGNILK YTERLNMFYLILKLLNHKELTNLKGSLEKYQSANKEEAFSDQLELIN LLNLDNNRVTEDFELEADEIGKFLDFNGNKVKDNKELKKFDTNKIY FDGENIIKHRAFYNIKKYGMLNLLEKIADKAGYKISIEELKKYSNKK NEIEKNHKMQENLHRKYARPRKDEKFTDEDYESYKQAIENIEEYTH LKNKVEFNELNLLQGLLLRILHRLVGYTSIWERDLRFRLKGEFPENQ YIEEIFNFENKKNVKYKGGQIVEKYIKFYKELHQNDEVKINKYSSAN IKVLKQEKKDLYIRNYIAHFNYIPHAEISLLEVLENLRKLLSYDRKLK NAVMKSVVDILKEYGFVATFKIGADKKIGIQTLESEKIVHLKNLKKK KLMTDRNSEELCKLVKIMFEYKMEEKKSEN |
| 49 | *Leptotrichia shahii* (Lsh) C2c2 protein | MGNLFGHKRWYEVRDKKDFKIKRKVKVKRNYDGNKYILNINENN NKEKIDNNKFIRKYINYKKNDNILKEFTRKFHAGNILFKLKGKEGIIR IENNDDFLETEEVVLYIEAYGKSEKLKALGITKKKIIDEAIRQGITKD DKKIEIKRQENEEEIEIDIRDEYTNKTLNDCSIILRIIENDELETKKSIYE IFKNINMSLYKIIEKIIENETEKVFENRYYEEHLREKLLKDDKIDVILT NFMEIREKIKSNLEILGFVKFYLNVGGDKKKSKNKKMLVEKILNINV DLTVEDIADFVIKELEFWNITKRIEKVKKVNNEFLEKRRNRTYIKSY VLLDKHEKFKIERENKKDKIVKFFVENIKNNSIKEKIEKILAEFKIDEL IKKLEKELKKGNCDTEIFGIFKKHYKVNFDSKKFSKKSDEEKELYKII YRYLKGRIEKILVNEQKVRLKKMEKIEIEKILNESILSEKILKRVKQY TLEHIMYLGKLRHNDIDMTTVNTDDFSRLHAKEELDLELITFFASTN MELNKIFSRENINNDENIDFFGGDREKNYVLDKKILNSKIKIIRDLDFI DNKNNITNNFIRKFTKIGTNERNRILHAISKERDLQGTQDDYNKVINI IQNLKISDEEVSKALNLDVVFKDKKNIITKINDIKISEENNNDIKYLPS FSKVLPEILNLYRNNPKNEPFDTIETEKIVLNALIYVNKELYKKLILE DDLEENESKNIFLQELKKTLGNIDEIDENIIENYYKNAQISASKGNNK AIKKYQKKVIECYIGYLRKNYEELFDFSDFKMNIQEIKKQIKDINDN KTYERITVKTSDKTIVINDDFEYIISIFALLNSNAVINKIRNRFFATSV WLNTSEYQNIIDILDEIMQLNTLRNECITENWNLNLEEFIQKMKEIEK DFDDFKIQTKKEIFNNYYEDIKNNILTEFKDDINGCDVLEKKLEKIVI FDDETKFEIDKKSNILQDEQRKLSNINKKDLKKKVDQYIKDKDQEIK SKILCRIIFNSDFLKKYKKEIDNLIEDMESENENKFQEIYYPKERKNEL YIYKKNLFLNIGNPNFDKIYGLISNDIKMADAKFLFNIDGKNIRKNKI |

TABLE 3-continued

Cas13 Protein Sequences

| SEQ ID NO | Description | Sequence |
|---|---|---|
| | | SEIDAILKNLNDKLNGYSKEYKEKYIKKLKENDDFFAKNIQNKNYK SFEKDYNRVSEYKKIRDLVEFNYLNKIESYLIDINWKLAIQMARFER DMHYIVNGLRELGIIKLSGYNTGISRAYPKRNGSDGFYTTTAYYKFF DEESYKKFEKICYGFGIDLSENSEINKPENESIRNYISHFYIVRNPFAD YSIAEQIDRVSNLLSYSTRYNNSTYASVFEVFKKDVNLDYDELKKKF KLIGNNDILERLMKPKKVSVLELESYNSDYIKNLIIELLTKIENTNDT L |
| 50 | Rhodobacter capsulatus C2c2 amino acid sequence | MQIGKVQGRTISEFGDPAGGLKRKISTDGKNRKELPAHLSSDPKALI GQWISGIDKIYRKPDSRKSDGKAIHSPTPSKMQFDARDDLGEAFWK LVSEAGLAQDSDYDQFKRRLHPYGDKFQPADSGAKLKFEADPPEPQ AFHGRWYGAMSKRGNDAKELAAALYEHLHVDEKRIDGQPKRNPK TDKFAPGLVVARALGIESSVLPRGMARLARNWGEEEIQTYFVVDVA ASVKEVAKAAVSAAQAFDPPRQVSGRSLSPKVGFALAEHLERVTGS KRCSFDPAAGPSVLALHDEVKKTYKRLCARGKNAARAFPADKTEL LALMRHTHENRVRNQMVRMGRVSEYRGQQAGDLAQSHYWTSAG QTEIKESEIFVRLWVGAFALAGRSMKAWIDPMGKIVNTEKNDRDLT AAVNIRQVISNKEMVAEAMARRGIYFGETPELDRLGAEGNEGFVFA LLRYLRGCRNQTFHLGARAGFLKEIRKELEKTRWGKAKEAEHVVL TDKTVAAIRAIIDNDAKALGARLLADLSGAFVAHYASKEHFSTLYSE IVKAVKDAPEVSSGLPRLKLLLKRADGVRGYVHGLRDTRKHAFAT KLPPPPAPRELDDPATKARYIALLRLYDGPFRAYASGITGTALAGPA ARAKEAATALAQSVNVTKAYSDVMEGRSSRLRPPNDGETLREYLS ALTGETATEFRVQIGYESDSENARKQAEFIENYRRDMLAFMFEDYIR AKGFDWILKIEPGATAMTRAPVLPEPIDTRGQYEHWQAALYLVMH FVPASDVSNLLHQLRKWEALQGKYELVQDGDATDQADARREALD LVKRFRDVLVLFLKTGEARFEGRAAPFDLKPFRALFANPATFDRLF MATPTTARPAEDDPEGDGASEPELRVARTLRGLRQIARYNHMAVLS DLFAKHKVRDEEVARLAEIEDETQEKSQIVAAQELRTDLHDKVMK CHPKTISPEERQSYAAAIKTIEEHRFLVGRVYLGDHLRLHRLMMDVI GRLIDYAGAYERDTGTFLINASKQLGAGADWAVTIAGAANTDART QTRKDLAHFNVLDRADGTPDLTALVNRAREMMAYDRKRKNAVPR SILDMLARLGLTLKWQMKDHLLQDATITQAAIKHLDKVRLTVGGP AAVTEARFSQDYLQMVAAVFNGSVQNPKPRRRDDGDAWHKPPKP ATAQSQPDQKPPNKAPSAGSRLPPPQVGEVYEGVVVKVIDTGSLGF LAVEGVAGNIGLHISRLRRIREDAIIVGRRYRFRVEIYVPPKSNTSKL NAADLVRID |
| 51 | Carnobacterium gallinarum C2c2 amino acid sequence | MRITKVKIKLDNKLYQVTMQKEEKYGTLKLNEESRKSTAEILRLKK ASFNKSFHSKTINSQKENKNATIKKNGDYISQIFEKLVGVDTNKNIR KPKMSLTDLKDLPKKDLALFIKRKFKNDDIVEIKNLDLISLFYNALQ KVPGEHFTDESWADFCQEMMPYREYKNKFIERKIILLANSIEQNKGF SINPETFSKRKRVLHQWAIEVQERGDFSILDEKLSKLAEIYNFKKMC KRVQDELNDLEKSMKKGKNPEKEKEAYKKQKNFKIKTIWKDYPYK THIGLIEKIKENEELNQFNIEIGKYFEHYFPIKKERCTEDEPYYLNSETI ATTVNYQLKNALISYLMQIGKYKQFGLENQVLDSKKLQEIGIYEGF QTKFMDACVFATSSLKNIIEPMRSGDILGKREFKEAIATSSFVNYHHF FPYFPFELKGMKDRESELIPFGEQTEAKQMQNIWALRGSVQQIRNEI FHSFDKNQKFNLPQLDKSNFEFDASENSTGKSQSYIETDYKFLFEAE KNQLEQFFIERIKSSGALEYYPLKSLEKLFAKKEMKFSLGSQVVAFA PSYKKLVKKGHSYQTATEGTANYLGLSYYNRYELKEESFQAQYYL LKLIYQVVFLPNFSQGNSPAFRETVKAILRINKDEARKKMKKNKFL RKYAFEQVREMEFKETPDQYMSYLQSEMREEKVRKAEKNDKGFEK NITMNFEKLLMQIFVKGFDVFLTTFAGKELLLSSEEKVIKETEISLSK KINEREKTLKASIQVEHQLVATNSAISYWLFCKLLDSRHLNELRNEM IKFKQSRIKFNHTQHAELIQNLLPIVELTILSNDYDEKNDSQNVDVSA YFEDKSLYETAPYVQTDDRTRVSFRPILKLEKYHTKSLIEALLKDNP QFRVAATDIQEWMHKREEIGELVEKRKNLHTEWAEGQQTLGAEKR EEYRDYCKKIDRFNWKANKVTLTYLSQLHYLITDLLGRMVGFSALF ERDLVYFSRSFSELGGETYHISDYKNLSGVLRLNAEVKPIKIKNIKVI DNEENPYKGNEPEVKPFLDRLHAYLENVIGIKAVHGKIRNQTAHLS VLQLELSMIESMNNLRDLMAYDRKLKNAVTKSMIKILDKHGMILKL KIDENHKNFEIESLIPKEIIHLKDKAIKTNQVSEEYCQLVLALLTTNPG NQLN |
| 52 | Herbinix hemicellulosilytica C2c2 amino acid sequence | MKLTRRRISGNSVDQKITAAFYRDMSQGLLYYDSEDNDCTDKVIES MDFERSWRGRILKNGEDDKNPFYMPVKGLVGSNDKIVCEPIDVDSD PDNLDILINKNLTGFGRNLKAPDSNDTLENLIRKIQAGIPEEEVLPEL KKKIKEMIQKDIVNRKEQLLKSIKNNRIPPFSLEGSKLVPSTKKMKWLF KLIDVPNKTFNEKMLEKYWEIYDYDKLKANITNRLDKTDKKARSIS RAVSEELREYHKNLRTNYNRFVSGDRPAAGLDNGGSAKYNPDKEE FLLFLKEVEQYFKKYFPVKSKHSNKSKDKSLVDKYKNYCSYKVVK KEVNRSIINQLVAGLIQQGKLLYYFYYNDTWQEDFLNSYGLSYIQV EEAFKKSVMT SLSWGINRLT SFFIDDSNTVKFDDITTKKAKEAIESNY |

TABLE 3-continued

Cas13 Protein Sequences

| SEQ ID NO | Description | Sequence |
|---|---|---|
| | | FNKLRTCSRMQDHFKEKLAFFYPVYVKDKKDRPDDDIENLIVLVKN AIESVSYLRNRTFHFKESSLLELLKELDDKNSGQNKIDYSVAAEFIKR DIENLYDVFREQIRSLGIAEYYKADMISDCFKTCGLEFALYSPKNSL MPAFKNVYKRGANLNKAYIRDKGPKETGDQGQNSYKALEEYRELT WYIEVKNNDQSYNAYKNLLQLIYYHAFLPEVRENEALITDFINRTKE WNRKETEERLNTKNNKKHKNFDENDDITVNTYRYESIPDYQGESLD DYLKVLQRKQMARAKEVNEKEEGNNNYIQFIRDVVVWAFGAYLE NKLKNYKNELQPPLSKENIGLNDTLKELFPEEKVKSPFNIKCRFSIST FIDNKGKSTDNTSAEAVKTDGKEDEKDKKNIKRKDLLCFYLFLRLL DENEICKLQHQFIKYRCSLKERRFPGNRTKLEKETELLAELEELMEL VRFTMPSIPEISAKAESGYDTMIKKYFKDFIEKKVFKNPKTSNLYYH SDSKTPVTRKYMALLMRSAPLHLYKDIFKGYYLITKKECLEYIKLSN IIKDYQNSLNELHEQLERIKLKSEKQNGKDSLYLDKKDFYKVKEYV ENLEQVARYKHLQHKINFESLYRIFRIHVDIAARMVGYTQDWERDM HFLFKALVYNGVLEERRFEAIFNNNDDNNDGRIVKKIQNNLNNKNR ELVSMLCWNKKLNKNEFGAIIWKRNPIAHLNHFTQTEQNSKSSLES LINSLRILLAYDRKRQNAVTKTINDLLLNDYHIRIKWEGRVDEGQIY FNIKEKEDIENEPIIHLKHLHKKDCYIYKNSYMFDKQKEWICNGIKEE VYDKSILKCIGNLFKFDYEDKNKSSANPKHT |
| 156 | Paludibacter propionicigenes C2c2 amino acid sequence | MRVSKVKVKDGGKDKMVLVHRKTTGAQLVYSGQPVSNETSNILPE KKRQSFDLSTLNKTIIKFDTAKKQKLNVDQYKIVEKIFKYPKQELPK QIKAEEILPFLNHKFQEPVKYWKNGKEESFNLTLLIVEAVQAQDKR KLQPYYDWKTWYIQTKSDLLKKSIENNRIDLTENLSKRKKALLAWE TEFTASGSIDLTHYHKVYMTDVLCKMLQDVKPLTDDKGKINTNAY HRGLKKALQNHQPAIFGTREVPNEANRADNQLSIYHLEVVKYLEHY FPIKTSKRRNTADDIAHYLKAQTLKTTIEKQLVNAIRANIIQQGKTNH HELKADTTSNDLIRIKTNEAFVLNLTGTCAFAANNIRNMVDNEQTN DILGKGDFIKSLLKDNTNSQLYSFFFGEGLSTNKAEKETQLWGIRGA VQQIRNNVNHYKKDALKTVFNISNFENPTITDPKQQTNYADTIYKA RFINELEKIPEAFQQLKTGGAVSYYTIENLKSLLTTFQFSLCRSTIPF APGFKKVFNGGINYQNAKQDESFYELMLEQYLRKENFAEESYNAR YFMLKLIYNNLFLPGFTTDRKAFADSVGFVQMQNKKQAEKVNPRK KEAYAFEAVRPMTAADSIADYMAYVQSELMQEQNKKEEKVAEET RINFEKFVLQVFIKGFDSFLRAKEFDFVQMPQPQLTATASNQQKAD KLNQLEASITADCKLTPQYAKADDATHIAFYVFCKLLDAAHLSNLR NELIKFRESVNEFKFHHLLEIIEICLLSADVVPTDYRDLYSSEADCLA RLRPFIEQGADITNWSDLFVQSDKHSPVIHANIELSVKYGTTKLLEQI INKDTQFKTTEANFTAWNTAQKSIEQLIKQREDHHEQWVKAKNAD DKEKQERKREKSNFAQKFIEKHGDDYLDICDYINTYNWLDNKMHF VHLNRLHGLTIELLGRMAGFVALFDRDFQFFDEQQIADEFKLHGFV NLHSIDKKLNEVPTKKIKEIYDIRNKIIQINGNKINESVRANLIQFISSK RNYYNNAFLHVSNDEIKEKQMYDIRNHIAHFNYLTKDAADFSLIDLI NELRELLHYDRKLKNAVSKAFIDLFDKHGMILKLKLNADHKLKVES LEPKKIYHLGSSAKDKPEYQYCTNQVMMAYCNMCRSLLEMKK |
| 157 | Leptotrichia wadei (Lwa) C2c2 amino acid sequence | MYMKITKIDGVSHYKKQDKGILKKKWKDLDERKQREKIEARYNKQ IESKIYKEFFRLKNKKRIEKEEDQNIKSLYFFIKELYLNEKNEEWELK NINLEILDDKERVIKGYKFKEDVYFFKEGYKEYYLRILFNNLIEKVQ NENREKVRKNKEFLDLKEIFKKYKNRKIDLLLKSINNNKINLEYKKE NVNEEIYGINPTNDREMTFYELLKEIIEKKDEQKSILEEKLDNFDITNF LENIEKIFNEETEINIIKGKVLNELREYIKEKEENNSDNKLKQIYNLEL KKYIENNFSYKKQKSKSKNGKNDYLYLNFLKKIMFIEEVDEKKEIN KEKFKNKINSNFKNLFVQHILDYGKLLYYKENDEYIKNTGQLETKD LEYIKTKETLIRKMAVLVSFAANSYYNLFGRVSGDILGTEVVKSSKT NVIKVGSHIFKEKMLNYFFDFEIFDANKIVEILESISYSIYNVRNGVG HFNKLILGKYKKKDINTNKRIEEDLNNNEEIKGYFIKKRGEIERKVK EKFLSNNLQYYYSKEKIENYFEVYEFEILKRKIPFAPNFKRIIKKGED LFNNKNNKKYEYFKNFDKNSAEEKKEFLKTRNFLLKELYYNNFYK EFLSKKEEFEKIVLEVKEEKKSRGNINNKKSGVSFQSIDDYDTKINIS DYIASIHKKEMERVEKYNEEKQKDTAKYIRDFVEEIFLTGFINYLEK DKRLHFLKEEFSILCVVDFNININEEKIKEFLKENDSKTLNLY LFFNMIDSKRISEFRNELVKYKQFTKKRLDEEKEFLGIKIELYETLIEF VILTREKLDTKKSEEIDAWLVDKLYVKDSNEYKEYEEILKLFVDEKI LSSKEAPYYATDNKTPILLSNFEKTRKYGTQSFLSEIQSNYKYSKVE KENIEDYNKKEEIEQKKKSNIEKLQDLKVELHKKWEQNKITEKEIEK YNNTTRKINEYNYLKNKEELQNVYLLHEMLSDLLARNVAFFNKWE RDFKFIVIAIKQFLRENDKEKVNEFLNPPDNSKGKKVYFSVSKYKNT VENIDGIHKNFMNLIFLNNKFMNRKIDKMNCAIWVYFRNYIAHFLH LHTKNEKISLISQMNLLIKLFSYDKKVQNHILKSTKTLLEKYNIQINF EISNDKKNEVFKYKIKNRLYSKKGKMLGKNNKFEILENEFLENVKAM LEYSE |

TABLE 3-continued

Cas13 Protein Sequences

| SEQ ID NO | Description | Sequence |
|---|---|---|
| 158 | *Bergeyella zoohelcum* Cas13b | MENKTSLGNNIYYNPFKPQDKSYFAGYFNAAMENTDSVFRELGKR LKGKEYTSENFFDAIFKENISLVEYERYVKLLSDYFPMARLLDKKEV PIKERKENFKKNFKGIIKAVRDLRNFYTHKEHGEVEITDEIFGVLDE MLKSTVLTVKKKKVKTDKTKEILKKSIEKQLDILCQKKLEYLRDTA RKIEEKRRNQRERGEKELVAPFKYSDKRDDLIAAIYNDAFDVYIDK KKDSLKESSKAKYNTKSDPQQEEGDLKIPISKNGVVFLLSLFLTKQEI HAFKSKIAGFKATVIDEATVSEATVSHGKNSICFMATHEIFSHLAYK KLRKVRTAEINYGEAENAEQLSVYAKETLMMQMLDELSKVPDVV YQNLSEDVQKTFIEDWNEYLKENNGDVGTMEEEQVIHPVIRKRYED KFNYFAIRFLDEFAQFPTLRFQVHLGNYLHDSRPKENLISDRRIKEKI TVFGRLSELEHKKALFIKNTETNEDREHYWEIFPNPNYDFPKENISV NDKDFPIAGSILDREKQPVAGKIGIKVKLLNQQYVSEVDKAVKAHQ LKQRKASKPSIQNIIEEIVPINESNPKEAIVFGGQPTAYLSMNDIHSILY EFFDKWEKKKEKLEKKGEKELRKEIGKELEKKIVGKIQAQIQQIIDK DTNAKILKPYQDGNSTAIDKEKLIKDLKQEQNILQKLKDEQTVREKE YNDFIAYQDKNREINKVRDRNHKQYLKDNLKRKYPEAPARKEVLY YREKGKVAVWLANDIKRFMPTDFKNEWKGEQHSLLQKSLAYYEQ CKEELKNLLPEKVFQHLPFKLGGYFQQKYLYQFYTCYLDKRLEYIS GLVQQAENFKSENKVFKKVENECFKFLKKQNYTHKELDARVQSIL GYPIFLERGFMDEKPTIIKGKTFKGNEALFADWFRYYKEYQNFQTFY DTENYPLVELEKKQADRKRKTKIYQQKKNDVFTLLMAKHIFKSVPK QDSIDQFSLEDLYQSREERLGNQERARQTGERNTNYIWNKTVDLKL CDGKITVENVKLKNVGDFIKYEYDQRVQAFLKYEENIEWQAFLIKE SKEEENYPYVVEREIEQYEKVRREELLKEVHLIEEYILEKVKDKEILK KGDNQNFKYYILNGLLKQLKNEDVESYKVFNLNTEPEDVNINQLKQ EATDLEQKAFVLTYIRNKFAHNQLPKKEFWDYCQEKYGKIEKEKTY AEYFAEVFKKEKEALIK |
| 159 | *Prevotella intermedia* Cas13b | MEDDKKTTDSIRYELKDKHFWAAFLNLARHNVYITVNHINKILEEG EINRDGYETTLKNTWNEIKDINKKDRLSKLIIKHFPPFLEAATYRLNPT DTTKQKEEKQAEAQSLESLRKSFFVFIYKLRDLRNHYSHYKHSKSLE RPKFEEGLLEKMYNIFNASIRLVKEDYQYNKDINPDEDFKHLDRTEE EFNYYFTKDNEGNITESGLLFFVSLFLEKKDAIWMQQKLRGFKDNR ENKKKMTNEVFCRSRMLLPKLRLQSTQTQDWILLDMLNELIRCPKS LYERLREEDREKFRVPIEIADEDYDAEQEPPFKNTLVRHQDRFPYFAL RYFDYNEIFTNLRFQIDLGTYHFSIYKKQIGDYKESHHLTHKLYGFE RIQEFTKQNRPDEWRKFVKTFNSFETSKEPYIPETTPHYHLENQKIGI RFRNDNDKIWPSLKTNSEKNEKSKYKLDKSFQAEAFLSVHELLPMM FYYLLLKTENTDNDNEIETKKKENKNDKQEKHKIEEIIENKITEIYAL YDTFANGEIKSIDELEEYCKGKDIEIGHLPKQMIAILKDEHKVMATE AERKQEEMLVDVQKSLESLDNQINEEIENVERKNSSLKSGKIASWL VNDMMRFQPVQKDNEGKPLNNSKANSTEYQLLQRTLAFFGSEHER LAPYFKQTKLIESSNPHPFLKDTEWEKCNNILSFYRSYLEAKKNFLES LKPEDWEKNQYFLKLKEPKTKPKTLVQGWKNGFNLPRGIFTEPIRK WFMKHRENITVAELKRVGLVAKVIPLFFSEEYKDSVQPFYNYHFNV GNINKPDEKNFLNCEERRELLRKKKDEFKKMTDKEKEENPSYLEFK SWNKFERELRLVRNQDIVTWLLCMELFNKKKIKELNVEKIYLKNIN TNTTKKEKNTEEKNGEEKNIKEKNNILNRIMPMRLPIKVYGRENFSK NKKKKIRRNTFFTVYIEEKGTKLLKQGNFKALERDRRLGGLFSFVKT PSKAESKSNTISKLRVEYELGEYQKARIEIIKDMLALEKTLIDKYNSL DTDNFNKMLTDWLELKGEPDKASFQNDVDLLIAVRNAFSHNQYPM RNRIAFANINPFSLSSANTSEEKGLGIANQLKDTHKTIEKIIEIEKPIE TKE |
| 160 | *Prevotella buccae* Cas13b | MQKQDKLFVDRKKNAIFAFPPKYITIMENKEKPEPIYYELTDKHFWA AFLNLARHNVYTTINHINRRLEIAELKDDGYMMGIKGSWNEQAKK LDKKVRLRDLIMKHFPPFLEAAAYEMTNSKSPNNKEQREKEQSEALS LNNLKNVLFIFLEKLQVLRNYYSHYKYSEESPKPIFETSLLKNMYKV FDANVRLVKRDYMHHENIDMQRDFTHLNRKKQVGRTKNIIDSPNF HYHFADKEGNMTIAGLLFFVSLFLDKKDAIWMQKKLKGFKDGRNL REQMTNEVFCRSRISLPKLKLENVQTKDWMQLDMLNELVRCPKSL YERLREKDRESFKVPFDIFSDDYNAEEEPPFKNTLVRHQDRFPYFVLR YFDLNEIFEQLRFQIDLGTYHFSIYNKRIGDEDEVRHLTHHLYGFARI QDFAPQNQPEEWRKLVKDLDHFETSQEPYISKTAPHYHLENEKIGIK FCSAHNNLFPSLQTDKTCNGRSKFNLGTQFTAEAFLSVHELLPMMF YYLLLTKDYSRKESADKVEGIIRKEISNIYAIYDAFANNEINSIADLTR RLQNTNILQGHLPKQMISILKGRQKDMGKEAERKIGEMIDDTQRRL DLLCKQTNQKIRIGKRNAGLLKSGKIADWLVNDMMRFQPVQKDQN NIPINNSKANSTEYRMLQRALALFGSENFRLKAYFNQMNLVGNDNP HPFLAETQWEHQTNILSFYRNYLEARKKYLKGLKPQNWKQYQHFLI LKVQKTNRNTLVTGWKNSFNLPRGIFTQPIREWFEKHNNSKRIYDQI LSFDRVGFVAKAIPLYFAEEYKDNVQPFYDYPFNIGNRLKPKKRQFL DKKERVELWQKNKELFKNYPSEKKKTDLAYLDFLSWKKFERELRLI KNQDIVTWLMFKELFNMATVEGLKIGEIHLRDIDTNTANEESNNILN |

TABLE 3-continued

Cas13 Protein Sequences

| SEQ ID NO | Description | Sequence |
|---|---|---|
| | | RIMPMKLPVKTYETDNKGNILKERPLATFYIEETETKVLKQGNFKAL VKDRRLNGLFSFAETTDLNLEEHPISKLSVDLELIKYQTTRISIFEMTL GLEKKLIDKYSTLPTDSFRNMLERWLQCKANRPELKNYVNSLIAVR NAFSHNQYPMYDATLFAEVKKFTLFPSVDTKKIELNIAPQLLEIVGK AIKEIEKSENKN |
| 161 | *Porphyromonas gingivalis* Cas13b | MNTVPASENKGQSRTVEDDPQYFGLYLNLARENLIEVESHVRIKFG KKKLNEESLKQSLLCDHLLSVDRWTKVYGHSRRYLPFLHYFDPDSQ IEKDHDSKTGVDPDSAQRLIRELYSLLDFLRNDFSHNRLDGTTFEHL EVSPDISSFITGTYSLACGRAQSRFAVFFKPDDFVLAKNRKEQLISVA DGKECLTVSGFAFFICLFLDREQASGMLSRIRGFKRTDENWARAVH ETFCDLCIRHPHDRLESSNTKEALLLDMLNELNRCPRILYDMLPEEE RAQFLPALDENSMNNLSENSLDEESRLLWDGSSDWAEALTKRIRHQ DRFPYLMLRFIEEMDLLKGIRFRVDLGEIELDSYSKKVGRNGEYDRT ITDHALAFGKLSDFQNEEEVSRMISGEASYPVRFSLFAPRYAIYDNKI GYCHTSDPVYPKSKTGEKRALSNPQSMGFISVHDLRKLLLMELLCE GSFSRMQSDFLRKANRILDETAEGKLQFSALFPEMRHRFIPPQNPKS KDRREKAETTLEKYKQEIKGRKDKLNSQLLSAFDMDQRQLPSRLLD EWMNIRPASHSVKLRTYVKQLNEDCRLRLRKFRKDGDGKARAIPL VGEMATFLSQDIVRMIISEETKKLITSAYYNEMQRSLAQYAGEENRR QFRAIVAELRLLDPSSGHPFLSATMETAHRYTEGFYKCYLEKKREW LAKIFYRPEQDENTKRRISVFFVPDGEARKLLPLLIRRRMKEQNDLQ DWIRNKQAHPIDLPSHLFDSKVMELLKVKDGKKKWNEAFKDWWS TKYPDGMQPFYGLRRELNIHGKSVSYIPSDGKKFADCYTHLMEKTV RDKKRELRTAGKPVPPDLAADIKRSFHRAVNEREFMLRLVQEDDRL MLMAINKMMTDREEDILPGLKNIDSILDEENQFSLAVHAKVLEKEG EGGDNSLSLVPATIEIKSKRKDWSKYIRYRYDRRVPGLMSHFPEHK ATLDEVKTLLGEYDRCRIKIFDWAFALEGAIMSDRDLKPYLHESSSR EGKSGEHSTLVKMLVEKKGCLTPDESQYLILIRNKAAHNQFPCAAE MPLIYRDVSAKVGSIEGSSAKDLPEGSSLVDSLWKKYEMIIRKILPIL DPENRFFGKLLNNMSQPINDL |
| 162 | *Bacteroides pyogenes* Cas13b | MESIKNSQKSTGKTLQKDPPYFGLYLNMALLNVRKVENHIRKWLG DVALLPEKSGFHSLLTTDNLSSAKWTRFYYKSRKFLPFLEMFDSDK KSYENRRETAECLDTIDRQKISSLLKEVYGKLQDIRNAFSHYHIDDQ SVKHTALIISSEMHRFIENAYSFALQKTRARFTGVFVETDFLQAEEK GDNKKFFAIGGNEGIKLKDNALIFLICLFLDREEAFKFLSRATGFKST KEKGFLAVRETFCALCCRQPHERLLSVNPREALLMDMLNELNRCPD ILFEMLDEKDQKSFLPLLGEEEQAHILENSLNDELCEAIDDPFEMIAS LSKRVRYKNRFPYLMLRYIEEKNLLPFIRFRIDLGCLELASYPKKMG EENNYERSVTDHAMAFGRLTDFHNEDAVLQQITKGITDEVRFSLYA PRYAIYNNKIGFVRTSGSDKISFPTLKKKGGEGHCVAYTLQNTKSFG FISIYDLRKILLLSFLDKDKAKNIVSGLLEQCEKHWKDLSENLFDAIR TELQKEFPVPLIRYTLPRSKGGKLVSSKLADKQEKYESEFERRKEKL TEILSEKDFDLSQIPRRMIDEWLNVLPTSREKKLKGYVETLKLDCRE RLRVFEKREKGEHPLPPRIGEMATDLAKDIIRMVIDQGVKQRITSAY YSEIQRCLAQYAGDDNRRHLDSIIRELRLKDTKNGHPFLGKVLRPGL GHTEKLYQRYFEEKKEWLEATFYPAASPKRVPRFVNPPTGKQKELP LIIRNLMKERPEWRDWKQRKNSHPIDLPSQLFENEICRLLKDKIGKE PSGKLKWNEMFKLYWDKEFPNGMQRFYRCKRRVEVFDKVVEYEY SEEGGNYKKYYEALIDEVVRQKISSSKEKSKLQVEDLTLSVRRVFKR AINEKEYQLRLLCEDDRLLFMAVRDLYDWKEAQLDLDKIDNMLGE PVSVSQVIQLEGGQPDAVIKAECKLKDVSKLMRYCYDGRVKGLMP YFANHEATQEQVEMELRHYEDHRRRVFNWVFALEKSVLKNEKLRR FYEESQGGCEHRRCIDALRKASLVSEEEYEFLVHIRNKSAHNQFPDL EIGKLPPNVTSGFCECIWSKYKAIICRIIPFIDPERRFFGKLLEQK |
| 163 | Cas13c | MTEKKSIIFKNKSSVEIVKKDIFSQTPDNMIRNYKITLKISEKNPRVVE AEIEDLMNSTILKDGRRSARREKSMTERKLIEEKVAENYSLLANCPM EEVDSIKIYKIKRFLTYRSNMLLYFASINSFLCEGIKGKDNETEEIWH LKDNDVRKEKVKENFKNKLIQSTENYNSSLKNQIEEKEKLLRKESK KGAFYRTIIKKLQQERIKELSEKSLTEDCEKIIKLYSELRHPLMHYDY QYFENLFENKENSELTKNLNLDIFKSLPLVRKMKLNNKVNYLEDND TLFVLQKTKKAKTLYQIYDALCEQKNGFNKFINDFFVSDGEENTVF KQIINEKFQSEMEFLEKRISESEKKNEKLKKKFDSMKAHFHNINSED TKEAYFWDIHSSSNYKTKYNERKNLVNEYTELLGSSKEKKLLREEIT QINRKLLKLKQEMEEITKKNSLFRLEYKMKIAFGFLFCEFDGNISKF KDEFDASNQEKIIQYHKNGEKYLTYFLKEEEKEKFNLEKMQKIIQKT EEEDWLLPETKNNLFKFYLLTYLLLPYELKGDFLGFVKKHYYDIKN VDFMDENQNNIQVSQTVEKQEDYFYHKIRLFEKNTKKYEIVKYSIV PNEKLKQYFEDLGIDIKYLTGSVESGEKWLGENLGIDIKYLTVEQKS EVSEEKIKKFL |

TABLE 3-continued

Cas13 Protein Sequences

| SEQ ID NO | Description | Sequence |
|---|---|---|
| 164 | Cas13c | MEKDKKGEKIDISQEMIEEDLRKILILFSRLRHSMVHYDYEFYQALY SGKDFVISDKNNLENRMISQLLDLNIFKELSKVKLIKDKAISNYLDK NTTIHVLGQDIKAIRLLDIYRDICGSKNGFNKFINTMITISGEEDREYK EKVIEHFNKKMENLSTYLEKLEKQDNAKRNNKRVYNLLKQKLIEQ QKLKEWFGGPYVYDIHSSKRYKELYIERKKLVDRHSKLFEEGLDEK NKKELTKINDELSKLNSEMKEMTKLNSKYRLQYKLQLAFGFILEEF DLNIDTFINNFDKDKDLIISNFMKKRDIYLNRVLDRGDNRLKNIIKEY KFRDTEDIFCNDRDNNLVKLYILMYILLPVEIRGDFLGFVKKNYYD MKHVDFIDKKDKEDKDTFFHDLRLFEKNIRKLEITDYSLSSGFLSKE HKVDIEKKINDFINRNGAMKLPEDITIEEFNKSLILPIMKNYQINFKLL NDIEISALFKIAKDRSITFKQAIDEIKNEDIKKNSKKNDKNNHKDKNI NFTQLMKRALHEKIPYKAGMYQIRNNISHIDMEQLYIDPLNSYMNS NKNNITISEQIEKIIDVCVTGGVTGKELNNNIINDYYMKKEKLVFNL KLRKQNDIVSIESQEKNKREEFVKKYGLDYKDGEINIIEVIQKVNSL QEELRNIKETSKEKLKNKETLFRDISLINGTIRKNINFKIKEMVLDIVR MDEIRHINIHIYYKGENYTRSNIIKFKYAIDGENKKYYLKQHEINDIN LELKDKFVTLICNMDKHPNKNKQTINLESNYIQNVKFIIP |
| 165 | Cas13c | MENKGNNKKIDFDENYNILVAQIKEYFTKEIENYNNRIDNIIDKKEL LKYSEKKEESEKNKKLEELNKLKSQKLKILTDEEIKADVIKIIKIFSDL RHSLMHYEYKYFENLFENKKNEELAELLNLNLFKNLTLLRQMKIEN KTNYLEGREEFNIIGKNIKAKEVLGHYNLLAEQKNGFNNFINSFFVQ DGTENLEFKKLIDEHFVNAKKRLERNIKKSKKLEKELEKMEQHYQR LNCAYVWDIHTSTTYKKLYNKRKSLIEEYNKQINEIKDKEVITAINV ELLRIKKEMEEITKSNSLFRLKYKMQIAYAFLEIEFGGNIAKFKDEFD CSKMEEVQKYLKKGVKYLKYYKDKEAQKNYEFPFEEIFENKDTHN EEWLENTSENNLFKFYILTYLLLPMEFKGDFLGVVKKHYYDIKNVD FTDESEKELSQVQLDKMIGDSFFHKIRLFEKNTKRYEIIKYSILTSDEI KRYFRLLELDVPYFEYEKGTDEIGIFNKNIILTIFKYYQHFRLYNDLEI HGLFNISSDLDKILRDLKSYGNKNINFREFLYVIKQNNNSSTEEEYRK IWENLEAKYLRLHLLTPEKEEIKTKTKEELEKLNEISNLRNGICHLNY KEHEEILKTEISEKNKEATLNEKIRKVINFIKENELDKVELGFNFINDF FMKKEQFMFGQIKQVKEGNSDSITTERERKEKNNKKLKETYELNCD NLSEFYETSNNLRERANSSSLLEDSAFLKKIGLYKVKNNKVNSKVK DEEKRIENIKRKLLKDSSDIMGMYKAEVVKKLKEKLILIFKHDEEKR IYVTVYDTSKAVPENISKEILVKRNNSKEEYFFEDNNKKYVTEYYTL EITETNELKVIPAKKLEGKEFKTEKNKENKLMLNNHYCFNVKIIY |
| 166 | Cas13c | MEEIKHKKNKSSIIRVIVSNYDMTGIKEIKVLYQKGGVDTFNLKTII NLESGNLEIISCKPKEREKYRYEFNCKTEINTISITKKDKVLKKEIRKY SLELYFKNEKKDTVVAKVTDLLKAPDKIEGERNHLRKLSSSTERKL LSKTLCKNYSEISKTPIEEIDSIKIYKIKRFLNYRSNFLIYFALINDFLC AGVKEDDINEVWLIQDKEHTAFLENRIEKITDYIFDKLSKDIENKKN QFEKRIKKYKTSLEELKTETLEKNKTFYIDSIKTKITNLENKITELSLY NSKESLKEDLIKIISIFTNLRHSLMHYDYKSFENLFENIENEELKNLLD LNLFKSIRMSDEFKTKNRTNYLDGTESFTIVKKHQNLKKLYTYYNN LCDKKNGFNTFINSFFVTDGIENTDFKNLIILHFEKEMEEYKKSIEYY KIKISNEKNKSKKEKLKEKIDLLQSELINMREHKNLLKQIYFFDIHNSI KYKELYSERKNLIEQYNLQINGVKDVTAINHINTKLLSLKNKMDKIT KQNSLYRLKYKLKIAYSFLMIEFDGDVSKFKNNFDPTNLEKRVEYL DKKEEYLNYTAPKNKFNFAKLEEELQKIQSTSEMGADYLNVSPENN LFKFYILTYIMLPVEFKGDFLGFVKNHYYNIKNVDFMDESLLDENEV DSNKLNEKIENLKDSSFFNKIRLFEKNIKKYEIVKYSVSTQENMKEY FKQLNLDIPYLDYKSTDEIGIFNKNMILPIFKYYQNVFKLCNDIEIHA LLALANKKQQNLEYAIYCCSKKNSLNYNELLKTFNRKTYQNLSFIR NKIAHLNYKELFSDLFNNELDLNTKVRCLIEFSQNNKFDQIDLGMNF INDYYMKKTRFIFNQRRLRDLNVPSKEKIIIDGKRKQQNDSNNELLK KYGLSRTNIKDIFNKAWY |
| 167 | Cas13c | MKVRYRKQAQLDTFIIKTEIVNNDIFIKSIIEKAREKYRYSFLFDGEE KYHFKNKSSVEIVKNDIFSQTPDNMIRNYKITLKISEKNPRVVEAEIE DLMNSTILKDGRRSARREKSMTERKLIEEKVAENYSLLANCPIEEVD SIKIYKIKRFLTYRSNMLLYFASINSFLCEGIKGKDNETEEIWHLKDN DVRKEKVKENFKNKLIQSTENYNSSLKNQIEEKEKLSSKEFKKGAFY RTIIKKLQQERIKELSEKSLTEDCEKIIKLYSELRHPLMHYDYQYFEN LFENKENSELTKNLNLDIFKSLPLVRKMKLNNKVNYLEDNDTLFVL QKTKKAKTLYQIYDALCEQKNGFNKFINDFFVSDGEENTVFKQIINE KFQSEMEFLEKRISESEKKNEKLKKKLDSMKAHFRNINSEDTKEAYF WDIHSSRNYKTKYNERKNLVNEYTKLLGSSKEKKLLREEITKINRQL LKLKQEMEEITKKNSLFRLEYKMKIAFGFLFCEFDGNISKFKDEFDA SNQEKIIQYHKNGEKYLTSFLKEEEEKFNLEKMQKIIQKTEEEDWL LPETKNNLFKFYLLTYLLLPYELKGDFLGFVKKHYYDIKNVDFMDE NQNNIQVSQTVEKQEDYFHKIRLFEKNTKKYEIVKYSIVPNEKLKQ YFEDLGIDIKYLTGSVESGEKWLGENLGIDIKYLTVEQKSEVSEEKN |

TABLE 3-continued

Cas13 Protein Sequences

| SEQ ID NO | Description | Sequence |
|---|---|---|
| | | KKVSLKNNGMFNKTILLFVFKYYQIAFKLFNDIELYSLFFLREKSEKP<br>FEVFLEELKDKMIGKQLNFGQLLYVVYEVLVKNKDLDKILSKKIDY<br>RKDKSFSPEIAYLRNFLSHLNYSKFLDNFMKINTNKSDENKEVLIPSI<br>KIQKMIQFIEKCNLQNQIDFDFNFVNDFYMRKEKMFFIQLKQIFPDIN<br>STEKQKKSEKEEILRKRYHLINKKNEQIKDEHEAQSQLYEKILSLQKI<br>FSCDKNNFYRRLKEEKLLFLEKQGKKKISMKEIKDKIASDISDLLGIL<br>KKEITRDIKDKLTEKFRYCEEKLLNISFYNHQDKKKEEGIRVFLIRDK<br>NSDNFKFESILDDGSNKIFISKNGKEITIQCCDKVLETLMIEKNTLKIS<br>SNGKIISLIPHYSYSIDVKY |

The programmable nuclease can be Cas13. Sometimes the Cas13 can be Cas13a, Cas13b, Cas13c, Cas13d, or Cas13e. In some cases, the programmable nuclease can be Mad7 or Mad2. In some cases, the programmable nuclease can be Cas12. Sometimes the Cas12 can be Cas12a, Cas12b, Cas12c, Cas12d, or Cas12e. In some cases, the Cas12 can be Cas12M08, which is a specific protein variant within the Cas12 protein family/classification) In some cases, the programmable nuclease can be Csm1, Cas9, C2c4, C2c8, C2c5, C2c10, C2c9, or CasZ. Sometimes, the Csm1 can also be also called smCms1, miCms1, obCms1, or suCms1. Sometimes Cas13a can also be also called C2c2. Sometimes CasZ can also be called Cas14a, Cas14b, Cas14c, Cas14d, Cas14e, Cas14f, Cas14g, or Cas14h. Sometimes, the programmable nuclease can be a type V CRISPR-Cas system. In some cases, the programmable nuclease can be a type VI CRISPR-Cas system. Sometimes the programmable nuclease can be a type III CRISPR-Cas system. In some cases, the programmable nuclease can be from at least one of *Leptotrichia shahii* (Lsh), *Listeria seeligeri* (Lse), *Leptotrichia buccalis* (Lbu), *Leptotrichia wadeu* (Lwa), *Rhodobacter capsulatus* (Rca), *Herbinix hemicellulosilytica* (Hhe), *Paludibacter propionicigenes* (Ppr), *Lachnospiraceae bacterium* (Lba), [*Eubacterium*] *rectale* (Ere), *Listeria newyorkensis* (Lny), *Clostridium aminophilum* (Cam), *Prevotella* sp. (Psm), *Capnocytophaga canimorsus* (Cca, *Lachnospiraceae bacterium* (Lba), *Bergeyella zoohelcum* (Bzo), *Prevotella intermedia* (Pin), *Prevotella buccae* (Pbu), *Alistipes* sp. (Asp), *Riemerella anatipestifer* (Ran), *Prevotella aurantiaca* (Pau), *Prevotella saccharolytica* (Psa), *Prevotella intermedia* (Pint), *Capnocytophaga canimorsus* (Cca), *Porphyromonas gulae* (Pgu), *Prevotella* sp. (Psp), *Porphyromonas gingivalis* (Pig), *Prevotella intermedia* (Pin3), *Enterococcus italicus* (Ei), *Lactobacillus salivarius* (Ls), or *Thermus thermophilus* (Tt). Sometimes the Cas13 is at least one of LbuCas13a, LwaCas13a, LbaCas13a, HheCas13a, PprCas13a, EreCas13a, CamCas13a, or LshCas13a. The trans cleavage activity of the CRISPR enzyme can be activated when the crRNA is complexed with the target nucleic acid. The trans cleavage activity of the CRISPR enzyme can be activated when the guide nucleic acid comprising a tracrRNA and crRNA are complexed with the target nucleic acid. The target nucleic acid can be RNA or DNA.

In some embodiments, a programmable nuclease as disclosed herein is an RNA-activated programmable RNA nuclease. In some embodiments, a programmable nuclease as disclosed herein is a DNA-activated programmable RNA nuclease. In some embodiments, a programmable nuclease is capable of being activated by a target RNA to initiate trans cleavage of an RNA reporter and is capable of being activated by a target DNA to initiate trans cleavage of an RNA reporter, such as a Type VI CRISPR/Cas enzyme (e.g., a Cas13 nuclease). For example, Cas13a of the present disclosure can be activated by a target RNA to initiate trans cleavage activity of the Cas13a for the cleavage of an RNA reporter and can be activated by a target DNA to initiate trans cleavage activity of the Cas13a for trans cleavage of an RNA reporter. An RNA reporter can be an RNA-based reporter molecule. In some embodiments, the Cas13a recognizes and detects ssDNA to initiate transcleavage of RNA reporters. Multiple Cas13a isolates can recognize, be activated by, and detect target DNA, including ssDNA, upon hybridization of a guide nucleic acid with the target DNA. For example, Lbu-Cas13a and Lwa-Cas13a can both be activated to transcollaterally cleave RNA reporters by target DNA. Thus, Type VI CRISPR/Cas enzyme (e.g., a Cas13 nuclease, such as Cas13a) can be DNA-activated programmable RNA nucleases, and therefore, can be used to detect a target DNA using the methods as described herein. DNA-activated programmable RNA nuclease detection of ssDNA can be robust at multiple pH values. For example, target ssDNA detection by Cas13 can exhibit consistent cleavage across a wide range of pH conditions, such as from a pH of 6.8 to a pH of 8.2. In contrast, target RNA detection by Cas13 may exhibit high cleavage activity of pH values from 7.9 to 8.2. In some embodiments, a DNA-activated programmable RNA nuclease that also is capable of being an RNA-activated programmable RNA nuclease, can have DNA targeting preferences that are distinct from its RNA targeting preferences. For example, the optimal ssDNA targets for Cas13a have different properties than optimal RNA targets for Cas13a. As one example, gRNA performance on ssDNA may not necessarily correlate with the performance of the same gRNAs on RNA. As another example, gRNAs can perform at a high level regardless of target nucleotide identity at a 3' position on a target RNA sequence. In some embodiments, gRNAs can perform at a high level in the absence of a G at a 3' position on a target ssDNA sequence. Furthermore, target DNA detected by Cas13 disclosed herein can be directly from organisms, or can be indirectly generated by nucleic acid amplification methods, such as PCR and LAMP or any amplification method described herein. Key steps for the sensitive detection of a target DNA, such as a target ssDNA, by a DNA-activated programmable RNA nuclease, such as Cas13a, can include: (1) production or isolation of DNA to concentrations above about 0.1 nM per reaction for in vitro diagnostics, (2) selection of a target sequence with the appropriate sequence features to enable DNA detection as these features are distinct from those required for RNA detection, and (3) buffer composition that enhances DNA detection. The detection of a target DNA by a DNA-activated programmable RNA nuclease can be connected to a variety of readouts including fluorescence, lateral flow, electrochemistry, or any other readouts described herein. Multiplexing of programmable DNA nuclease, such as a Type V CRISPR-Cas protein, with a DNA-activated programmable RNA nuclease, such as a Type VI protein, with a DNA reporter and an RNA reporter, can enable multiplexed detection of target ssDNAs or a combination of a target dsDNA and a target ssDNA, respectively. Multiplexing of different RNA-activated programmable RNA nucleases that have distinct RNA reporter cleavage preferences can enable additional multiplexing. Methods for the generation of ssDNA for DNA-activated programmable RNA nuclease-based diagnostics can include (1) asymmetric PCR, (2) asymmetric isothermal amplification, such as RPA, LAMP, SDA, etc. (3) NEAR for the production of short ssDNA molecules, and (4) conversion of RNA targets into ssDNA by a reverse transcriptase followed by RNase H digestion. Thus, DNA-activated programmable RNA nuclease detection of target DNA is compatible with the various systems, kits, compositions, reagents, and methods disclosed herein. For example target ssDNA detection by Cas13a can be employed in a DETECTR assay disclosed herein.

A programmable nuclease can comprise a programmable nuclease capable of being activated when complexed with a guide nucleic acid and target nucleic acid. The programmable nuclease can become activated after binding of a guide nucleic acid with a target nucleic acid, in which the activated programmable nuclease can cleave the target nucleic acid and can have trans cleavage activity. Trans cleavage activity can be non-specific cleavage of nearby nucleic acids by the activated programmable nuclease, such as trans cleavage of detector nucleic acids with a detection moiety. Once the detector nucleic acid is cleaved by the activated programmable nuclease, the detection moiety can be released from the detector nucleic acid and can generate a signal. The signal can be immobilized on a support medium for detection. The signal can be visualized to assess whether a target nucleic acid comprises a modification.

Reporter

Reporters, which can be referred to interchangeably reporter molecules, or detector nucleic acids, described herein are compatible for use in the devices described herein (e.g., pneumatic valve devices, sliding valve devices, rotating valve devices, and lateral flow devices) and may be used in conjunction with compositions disclosed herein (e.g., programmable nucleases, guide nucleic acids, reagents for in vitro transcription, reagents for amplification, reagents for reverse transcription, reporters, or any combination thereof) to carry out highly efficient, rapid, and accurate reactions for detecting whether a target nucleic acid is present in a sample (e.g., DETECTR reactions). Described herein is a reporter comprising a single stranded detector nucleic acid comprising a detection moiety, wherein the reporter is capable of being cleaved by the activated programmable nuclease, thereby generating a first detectable signal. As used herein, a detector nucleic acid is used interchangeably with reporter or reporter molecule. In some cases, the detector nucleic acid is a single-stranded nucleic acid comprising deoxyribonucleotides. In other cases, the detector nucleic acid is a single-stranded nucleic acid comprising ribonucleotides. The detector nucleic acid can be a single-stranded nucleic acid comprising at least one deoxyribonucleotide and at least one ribonucleotide. In some cases, the detector nucleic acid is a single-stranded nucleic acid comprising at least one ribonucleotide residue at an internal position that functions as a cleavage site. In some cases, the detector nucleic acid comprises at least 2, 3, 4, 5, 6, 7, 8, 9, or 10 ribonucleotide residues at an internal position. In some cases, the detector nucleic acid comprises from 2 to 10, from 3 to 9, from 4 to 8, or from 5 to 7 ribonucleotide residues at an internal position. In some cases, the detector nucleic acid comprises from 3 to 10, from 4 to 10, from 5 to 10, from 6 to 10, from 7 to 10, from 8 to 10, from 9 to 10, from 2 to 8, from 3 to 8, from 5 to 8, from 6 to 8, from 7 to 8, from 2 to 5, from 3 to 5, or from 4 to 5 ribonucleotide residues at an internal position. Sometimes the ribonucleotide residues are continuous. Alternatively, the ribonucleotide residues are interspersed in between non-ribonucleotide residues. In some cases, the detector nucleic acid has only ribonucleotide residues. In some cases, the detector nucleic acid has only deoxyribonucleotide residues. In some cases, the detector nucleic acid comprises nucleotides resistant to cleavage by the programmable nuclease described herein. In some cases, the detector nucleic acid comprises synthetic nucleotides. In some cases, the detector nucleic acid comprises at least one ribonucleotide residue and at least one non-ribonucleotide residue. In some cases, the detector nucleic acid is 5-20, 5-15, 5-10, 7-20, 7-15, or 7-10 nucleotides in length. In some cases, the detector nucleic acid is from 3 to 20, from 4 to 20, from 5 to 20, from 6 to 20, from 7 to 20, from 8 to 20, from 9 to 20, from 10 to 20, from 15 to 20, from 3 to 15, from 4 to 15, from 5 to 15, from 6 to 15, from 7 to 15, from 8 to 15, from 9 to 15, from 10 to 15, from 3 to 10, from 4 to 10, from 5 to 10, from 6 to 10, from 7 to 10, from 8 to 10, from 9 to 10, from 3 to 8, from 4 to 8, from 5 to 8, from 6 to 8, or from 7 to 8 nucleotides in length. In some cases, the detector nucleic acid comprises at least one uracil ribonucleotide. In some cases, the detector nucleic acid comprises at least two uracil ribonucleotides. Sometimes the detector nucleic acid has only uracil ribonucleotides. In some cases, the detector nucleic acid comprises at least one adenine ribonucleotide. In some cases, the detector nucleic acid comprises at least two adenine ribonucleotide. In some cases, the detector nucleic acid has only adenine ribonucleotides. In some cases, the detector nucleic acid comprises at least one cytosine ribonucleotide. In some cases, the detector nucleic acid comprises at least two cytosine ribonucleotide. In some cases, the detector nucleic acid comprises at least one guanine ribonucleotide. In some cases, the detector nucleic acid comprises at least two guanine ribonucleotide. A detector nucleic acid can comprise only unmodified ribonucleotides, only unmodified deoxyribonucleotides, or a combination thereof. In some cases, the detector nucleic acid is from 5 to 12 nucleotides in length. In some cases, the detector nucleic acid is at least 2, 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides in length. In some cases, the detector nucleic acid is 2, 3, 4, 5, 6, 7, 8, 9, 10, 11, 12, 13, 14, 15, 16, 17, 18, 19, 20, 21, 22, 23, 24, 25, 26, 27, 28, 29, or 30 nucleotides in length. For cleavage by a programmable nuclease comprising Cas13, a detector nucleic acid can be 5, 8, or 10 nucleotides in length. For cleavage by a programmable nuclease comprising Cas12, a detector nucleic acid can be 10 nucleotides in length.

The single stranded detector nucleic acid can comprise a detection moiety capable of generating a first detectable signal. Sometimes the detector nucleic acid comprises a protein capable of generating a signal. A signal can be a calorimetric, potentiometric, amperometric, optical (e.g., fluorescent, colorometric, etc.), or piezo-electric signal. In some cases, a detection moiety is on one side of the cleavage site. Optionally, a quenching moiety is on the other side of the cleavage site. Sometimes the quenching moiety is a fluorescence quenching moiety. In some cases, the quenching moiety is 5' to the cleavage site and the detection moiety is 3' to the cleavage site. In some cases, the detection moiety is 5' to the cleavage site and the quenching moiety is 3' to the cleavage site. Sometimes the quenching moiety is at the 5' terminus of the detector nucleic acid. Sometimes the detection moiety is at the 3' terminus of the detector nucleic acid. In some cases, the detection moiety is at the 5' terminus of the detector nucleic acid. In some cases, the quenching moiety is at the 3' terminus of the detector nucleic acid. In some cases, the single-stranded detector nucleic acid is at least one population of the single-stranded nucleic acid capable of generating a first detectable signal. In some cases, the single-stranded detector nucleic acid is a population of the single stranded nucleic acid capable of generating a first detectable signal. Optionally, there are more than one population of single-stranded detector nucleic acid. In some cases, there are 2, 3, 4, 5, 6, 7, 8, 9, 10, 11, 12, 13, 14, 15, 20, 30, 40, 50, or greater than 50, or any number spanned by the range of this list of different populations of single-stranded detector nucleic acids capable of generating a detectable signal. In some cases there are from 2 to 50, from 3 to 40, from 4 to 30, from 5 to 20, or from 6 to 10 different populations of single-stranded detector nucleic acids capable of generating a detectable signal. In some cases there are from 2 to 50, from 5 to 50, from 10 to 50, from 15 to 50, from 20 to 50, from 25 to 50, from 30 to 50, from 35 to 50, from 40 to 50, from 2 to 40, from 5 to 40, from 10 to 40, from 15 to 40, from 20 to 40, from 25 to 40, from 30 to 40, from 35 to 40, from 2 to 30, from 5 to 30, from 10 to 30, from 15 to 30, from 20 to 30, from 25 to 30, from 2 to 20, from 5 to 20, from 10 to 20, from 15 to 20, from 2 to 10, or from 5 to 10 different populations of single-stranded detector nucleic acids capable of generating a detectable signal.

TABLE 4

Exemplary Single Stranded Detector Nucleic Acid

| 5' Detection Moiety* | Sequence (SEQ ID NO:) | 3' Quencher* |
|---|---|---|
| /56-FAM/ | rUrUrUrUrU (SEQ ID NO: 1) | /3IABkFQ/ |
| /5IRD700/ | rUrUrUrUrU (SEQ ID NO: 1) | /3IRQC1N/ |
| /5TYE665/ | rUrUrUrUrU (SEQ ID NO: 1) | /3IAbRQSp/ |
| /5Alex594N/ | rUrUrUrUrU (SEQ ID NO: 1) | /3IAbRQSp/ |
| /5ATTO633N/ | rUrUrUrUrU (SEQ ID NO: 1) | /3IAbRQSp/ |
| /56-FAM/ | rUrUrUrUrUrUrUrU (SEQ ID NO: 2) | /3IABkFQ/ |
| /5IRD700/ | rUrUrUrUrUrUrUrU (SEQ ID NO: 2) | /3IRQC1N/ |
| /5TYE665/ | rUrUrUrUrUrUrUrU (SEQ ID NO: 2) | /3IAbRQSp/ |
| /5Alex594N/ | rUrUrUrUrUrUrUrU (SEQ ID NO: 2) | /3IAbRQSp/ |
| /5ATTO633N/ | rUrUrUrUrUrUrUrU (SEQ ID NO: 2) | /3IAbRQSp/ |
| /56-FAM/ | rUrUrUrUrUrUrUrUrU (SEQ ID NO: 3) | /3IABkFQ/ |
| /5IRD700/ | rUrUrUrUrUrUrUrUrU (SEQ ID NO: 3) | /3IRQC1N/ |
| /5TYE665/ | rUrUrUrUrUrUrUrUrU (SEQ ID NO: 3) | /3IAbRQSp/ |
| /5Alex594N/ | rUrUrUrUrUrUrUrUrU (SEQ ID NO: 3) | /3IAbRQSp/ |
| /5ATTO633N/ | rUrUrUrUrUrUrUrUrU (SEQ ID NO: 3) | /3IAbRQSp/ |
| /56-FAM/ | TTTTrUrUTTTT (SEQ ID NO: 4) | /3IABkFQ/ |
| /5IRD700/ | TTTTrUrUTTTT (SEQ ID NO: 4) | /3IRQC1N/ |
| /5TYE665/ | TTTTrUrUTTTT (SEQ ID NO: 4) | /3IAbRQSp/ |
| /5Alex594N/ | TTTTrUrUTTTT (SEQ ID NO: 4) | /3IAbRQSp/ |
| /5ATTO633N/ | TTTTrUrUTTTT (SEQ ID NO: 4) | /3IAbRQSp/ |
| /56-FAM/ | TTrUrUTT (SEQ ID NO: 5) | /3IABkFQ/ |
| /5IRD700/ | TTrUrUTT (SEQ ID NO: 5) | /3IRQC1N/ |
| /5TYE665/ | TTrUrUTT (SEQ ID NO: 5) | /3IAbRQSp/ |
| /5Alex594N/ | TTrUrUTT (SEQ ID NO: 5) | /3IAbRQSp/ |
| /5ATTO633N/ | TTrUrUTT (SEQ ID NO: 5) | /3IAbRQSp/ |
| /56-FAM/ | TArArUGC (SEQ ID NO: 6) | /3IABkFQ/ |
| /5IRD700/ | TArArUGC (SEQ ID NO: 6) | /3IRQC1N/ |
| /5TYE665/ | TArArUGC (SEQ ID NO: 6) | /3IAbRQSp/ |
| /5Alex594N/ | TArArUGC (SEQ ID NO: 6) | /3IAbRQSp/ |
| /5ATTO633N/ | TArArUGC (SEQ ID NO: 6) | /3IAbRQSp/ |
| /56-FAM/ | TArUGGC (SEQ ID NO: 7) | /3IABkFQ/ |
| /5IRD700/ | TArUGGC (SEQ ID NO: 7) | /3IRQC1N/ |
| /5TYE665/ | TArUGGC (SEQ ID NO: 7) | /3IAbRQSp/ |
| /5Alex594N/ | TArUGGC (SEQ ID NO: 7) | /3IAbRQSp/ |
| /5ATTO633N/ | TArUGGC (SEQ ID NO: 7) | /3IAbRQSp/ |
| /56-FAM/ | rUrUrUrUrU (SEQ ID NO: 8) | /3IABkFQ/ |
| /5IRD700/ | rUrUrUrUrU (SEQ ID NO: 8) | /3IRQC1N/ |
| /5TYE665/ | rUrUrUrUrU (SEQ ID NO: 8) | /3IAbRQSp/ |
| /5Alex594N/ | rUrUrUrUrU (SEQ ID NO: 8) | /3IAbRQSp/ |
| /5ATTO633N/ | rUrUrUrUrU (SEQ ID NO: 8) | /3IAbRQSp/ |
| /56-FAM/ | TTATTATT (SEQ ID NO: 9) | /3IABkFQ/ |
| /56-FAM/ | TTATTATT (SEQ ID NO: 9) | /3IABkFQ/ |
| /5IRD700/ | TTATTATT (SEQ ID NO: 9) | /3IRQC1N/ |
| /5TYE665/ | TTATTATT (SEQ ID NO: 9) | /3IAbRQSp/ |
| /5Alex594N/ | TTATTATT (SEQ ID NO: 9) | /3IAbRQSp/ |

TABLE 4-continued

Exemplary Single Stranded Detector Nucleic Acid

| 5' Detection Moiety* | Sequence (SEQ ID NO:) | 3' Quencher* |
|---|---|---|
| /5ATTO633N/ | TTATTATT (SEQ ID NO: 9) | /3IAbRQSp/ |
| /56-FAM/ | TTTTTT (SEQ ID NO: 10) | /3IABkFQ/ |
| /56-FAM/ | TTTTTTT (SEQ ID NO: 11) | /3IABkFQ/ |
| /56-FAM/ | TTTTTTTTT (SEQ ID NO: 12) | /3IABkFQ/ |
| /56-FAM/ | TTTTTTTTTTT (SEQ ID NO: 13) | /3IABkFQ/ |
| /56-FAM/ | TTTTTTTTTTTTT (SEQ ID NO: 14) | /3IABkFQ/ |
| /56-FAM/ | AAAAAA (SEQ ID NO: 15) | /3IABkFQ/ |
| /56-FAM/ | CCCCCC (SEQ ID NO: 16) | /3IABkFQ/ |
| /56-FAM/ | GGGGGG (SEQ ID NO: 17) | /3IABkFQ/ |
| /56-FAM/ | TTATTATT (SEQ ID NO: 9) | /3IABkFQ/ |

/56-FAM/: 5' 6-Fluorescein (Integrated DNA Technologies)
/3IABkFQ/: 3' Iowa Black FQ (Integrated DNA Technologies)
/5IRD700/: 5' IRDye 700 (Integrated DNA Technologies)
/5TYE665/: 5' TYE 665 (Integrated DNA Technologies)
/5Alex594N/: 5' Alexa Fluor 594 (NHS Ester) (Integrated DNA Technologies)
/5ATTO633N/: 5' ATTO TM 633 (NHS Ester) (Integrated DNA Technologies)
/3IRQC1N/: 3' IRDye QC-1 Quencher (Li-Cor)
/3IAbRQSp/: 3' Iowa Black RQ (Integrated DNA Technologies)
rU: uracil ribonucleotide
rG: guanine ribonucleotide
*This Table refers to the detection moiety and quencher moiety as their tradenames and their source is identified. However, alternatives, generics, or non-tradename moieties with similar function from other sources can also be used.

A detection moiety can be an infrared fluorophore. A detection moiety can be a fluorophore that emits fluorescence in the range of from 500 nm and 720 nm. A detection moiety can be a fluorophore that emits fluorescence in the range of from 500 nm and 720 nm. In some cases, the detection moiety emits fluorescence at a wavelength of 700 nm or higher. In other cases, the detection moiety emits fluorescence at about 660 nm or about 670 nm. In some cases, the detection moiety emits fluorescence in the range of from 500 to 520, 500 to 540, 500 to 590, 590 to 600, 600 to 610, 610 to 620, 620 to 630, 630 to 640, 640 to 650, 650 to 660, 660 to 670, 670 to 680, 680 to 690, 690 to 700, 700 to 710, 710 to 720, or 720 to 730 nm. In some cases, the detection moiety emits fluorescence in the range from 450 nm to 750 nm, from 500 nm to 750 nm, from 550 nm to 750 nm, from 600 nm to 750 nm, from 650 nm to 750 nm, from 700 nm to 750 nm, from 450 nm to 700 nm, from 500 nm to 700 nm, from 550 nm to 700 nm, from 600 nm to 700 nm, from 650 nm to 700 nm, from 450 nm to 650 nm, from 500 nm to 650 nm, from 550 nm to 650 nm, from 600 nm to 650 nm, from 450 nm to 600 nm, from 500 nm to 600 nm, from 550 nm to 600 nm, from 450 nm to 550 nm, from 500 nm to 550 nm, or from 450 nm to 500 nm. A detection moiety can be a fluorophore that emits a fluorescence in the same range as 6-Fluorescein, IRDye 700, TYE 665, Alex Fluor, or ATTO TM 633 (NHS Ester). A detection moiety can be fluorescein amidite, 6-Fluorescein, IRDye 700, TYE 665, Alex Fluor 594, or ATTO TM 633 (NHS Ester). A detection moiety can be a fluorophore that emits a fluorescence in the same range as 6-Fluorescein (Integrated DNA Technologies), IRDye 700 (Integrated DNA Technologies), TYE 665 (Integrated DNA Technologies), Alex Fluor 594 (Integrated DNA Technologies), or ATTO TM 633 (NHS Ester) (Integrated DNA Technologies). A detection moiety can be fluorescein amidite, 6-Fluorescein (Integrated DNA Technologies), a digoxigenin, IRDye 700 (Integrated DNA Technologies), TYE 665 (Integrated DNA Technologies), Alex Fluor 594 (Integrated DNA Technologies), or ATTO TM 633 (NHS Ester) (Integrated DNA Technologies). Other fluorophores consistent with the present disclosure include Alexa Fluor 405, Alexa 488, Cy2, Cy3, Cy3.5, Cy5, Cy5.5, Cy7, Alexa Fluor 647, or other suitable fluorophores. Any of the detection moieties described herein can be from any commercially available source, can be an alternative with a similar function, a generic, or a non-tradename of the detection moieties listed.

A detection moiety can be chosen for use based on the type of sample to be tested. For example, a detection moiety that is an infrared fluorophore is used with a urine sample. As another example, SEQ ID NO: 1 with a fluorophore that emits a fluorescence around 520 nm is used for testing in non-urine samples, and SEQ ID NO: 8 with a fluorophore that emits a fluorescence around 700 nm is used for testing in urine samples.

A quenching moiety can be chosen based on its ability to quench the detection moiety. A quenching moiety can be a non-fluorescent fluorescence quencher. A quenching moiety can quench a detection moiety that emits fluorescence in the range of from 500 nm and 720 nm. A quenching moiety can quench a detection moiety that emits fluorescence in the range of from 500 nm and 720 nm. In some cases, the quenching moiety quenches a detection moiety that emits fluorescence at a wavelength of 700 nm or higher. In other cases, the quenching moiety quenches a detection moiety that emits fluorescence at about 660 nm or about 670 nm. In some cases, the quenching moiety quenches a detection moiety that emits fluorescence in the range of from 500 to 520, 500 to 540, 500 to 590, 590 to 600, 600 to 610, 610 to 620, 620 to 630, 630 to 640, 640 to 650, 650 to 660, 660 to 670, 670 to 680, 680 to 690, 690 to 700, 700 to 710, 710 to 720, or 720 to 730 nm. In some cases, the quenching moiety quenches a detection moiety that emits fluorescence in the range from 450 nm to 750 nm, from 500 nm to 750 nm, from 550 nm to 750 nm, from 600 nm to 750 nm, from 650 nm to 750 nm, from 700 nm to 750 nm, from 450 nm to 700 nm, from 500 nm to 700 nm, from 550 nm to 700 nm, from 600 nm to 700 nm, from 650 nm to 700 nm, from 450 nm to 650 nm, from 500 nm to 650 nm, from 550 nm to 650 nm, from 600 nm to 650 nm, from 450 nm to 600 nm, from 500 nm to 600 nm, from 550 nm to 600 nm, from 450 nm to 550 nm, from 500 nm to 550 nm, or from 450 nm to 500 nm. A quenching moiety can quench fluorescein amidite, 6-Fluorescein, IRDye 700, TYE 665, Alex Fluor 594, or ATTO TM 633 (NHS Ester). A quenching moiety can be Iowa Black RQ, Iowa Black FQ or IRDye QC-1 Quencher. A quenching moiety can quench fluorescein amidite, 6-Fluorescein (Integrated DNA Technologies), IRDye 700 (Integrated DNA Technologies), TYE 665 (Integrated DNA Technologies), Alex Fluor 594 (Integrated DNA Technologies), or ATTO TM 633 (NHS Ester) (Integrated DNA Technologies). A quenching moiety can be Iowa Black RQ (Integrated DNA Technologies), Iowa Black FQ (Integrated DNA Technologies) or IRDye QC-1 Quencher (LiCor). Any of the quenching moieties described herein can be from any commercially available source, can be an alternative with a similar function, a generic, or a non-tradename of the quenching moieties listed.

The generation of the detectable signal from the release of the detection moiety indicates that cleavage by the programmable nuclease has occurred and that the sample contains the target nucleic acid. In some cases, the detection moiety comprises a fluorescent dye. Sometimes the detection moiety comprises a fluorescence resonance energy transfer (FRET) pair. In some cases, the detection moiety comprises an infrared (IR) dye. In some cases, the detection moiety comprises an ultraviolet (UV) dye. Alternatively or in combination, the detection moiety comprises a polypeptide. Sometimes the detection moiety comprises a biotin. Sometimes the detection moiety comprises at least one of avidin or streptavidin. In some instances, the detection moiety comprises a polysaccharide, a polymer, or a nanoparticle. In some instances, the detection moiety comprises a gold nanoparticle or a latex nanoparticle.

In some embodiments, the reporter comprises a nucleic acid conjugated to an affinity molecule and the affinity molecule conjugated to the fluorophore (e.g., nucleic acid-affinity molecule-fluophore) or the nucleic acid conjugated to the fluorophore and the fluorophore conjugated to the affinity molecule (e.g., nucleic acid-fluorophore-affinity molecule). In some embodiments, a linker conjugates the nucleic acid to the affinity molecule. In some embodiments, a linker conjugates the affinity molecule to the fluorophore. In some embodiments, a linker conjugates the nucleic acid to the fluorophore. A linker can be any suitable linker known in the art. In some embodiments, the nucleic acid of the reporter can be directly conjugated to the affinity molecule and the affinity molecule can be directly conjugated to the fluorophore or the nucleic acid can be directly conjugated to the fluorophore and the fluorophore can be directly conjugated to the affinity molecule. In this context, "directly conjugated" indicated that no intervening molecules, polypeptides, proteins, or other moieties are present between the two moieties directly conjugated to each other. For example, if a reporter comprises a nucleic acid directly conjugated to an affinity molecule and an affinity molecule directly conjugated to a fluorophore—no intervening moiety is present between the nucleic acid and the affinity molecule and no intervening moiety is present between the affinity molecule and the fluorophore. The affinity molecule can be biotin, avidin, streptavidin, or any similar molecule. Additional examples of affinity molecules are biotin, glutathione, maltose, or chitin.

A detection moiety can be any moiety capable of generating a calorimetric, potentiometric, amperometric, optical (e.g., fluorescent, colorometric, etc.), or piezo-electric signal. A detector nucleic acid, sometimes, is protein-nucleic acid that is capable of generating a calorimetric, potentiometric, amperometric, optical (e.g., fluorescent, colorometric, etc.), or piezo-electric signal upon cleavage of the nucleic acid. Often a calorimetric signal is heat produced after cleavage of the detector nucleic acids. Sometimes, a calorimetric signal is heat absorbed after cleavage of the detector nucleic acids. A potentiometric signal, for example, is electrical potential produced after cleavage of the detector nucleic acids. An amperometric signal can be movement of electrons produced after the cleavage of detector nucleic acid. Often, the signal is an optical signal, such as a colorometric signal or a fluorescence signal. An optical signal is, for example, a light output produced after the cleavage of the detector nucleic acids. Sometimes, an optical signal is a change in light absorbance between before and after the cleavage of detector nucleic acids. Often, a piezo-electric signal is a change in mass between before and after the cleavage of the detector nucleic acid.

Often, the protein-nucleic acid is an enzyme-nucleic acid. The enzyme may be sterically hindered when present as in the enzyme-nucleic acid, but then functional upon cleavage from the nucleic acid. The enzyme produces a reaction with a substrate. An enzyme can be invertase. Often, the substrate of invertase is sucrose and a DNS reagent can be used to monitor invertase activity. In some cases, it is preferred that the nucleic acid (e.g., DNA) and invertase are conjugated using a heterobifunctional linker via sulfo-SMCC chemistry.

Sometimes the protein-nucleic acid is a substrate-nucleic acid. Often the substrate is a substrate that produces a reaction with an enzyme.

A protein-nucleic acid may be attached to a solid support, for example as part of a microfluidic or lateral flow device as disclosed herein. The solid support, for example, is a surface. A surface can be an electrode. Sometimes the solid support is a bead. Often the bead is a magnetic bead. Upon cleavage, the protein is liberated from the solid and interacts with other mixtures. For example, the protein is an enzyme, and upon cleavage of the nucleic acid of the enzyme-nucleic acid, the enzyme flows through a chamber into a mixture comprising the substrate. When the enzyme meets the enzyme substrate, a reaction occurs, such as a colorimetric reaction, which is then detected. As another example, the protein is an enzyme substrate, and upon cleavage of the nucleic acid of the enzyme substrate-nucleic acid, the enzyme flows through a chamber into a mixture comprising the enzyme. When the enzyme substrate meets the enzyme, a reaction occurs, such as a calorimetric reaction, which is then detected.

In some cases, the reporter comprises a substrate-nucleic acid. The substrate may be sequestered from its cognate enzyme when present as in the substrate-nucleic acid, but then is released from the nucleic acid upon cleavage, wherein the released substrate can contact the cognate enzyme to produce a detectable signal. Often, the substrate is sucrose and the cognate enzyme is invertase, and a DNS reagent can be used to monitor invertase activity.

A major advantage of the devices and methods disclosed herein is the design of excess reporters to total nucleic acids in an unamplified or an amplified sample, not including the nucleic acid of the reporter. Total nucleic acids can include the target nucleic acids and non-target nucleic acids, not including the nucleic acid of the reporter. The non-target nucleic acids can be from the original sample, either lysed or unlysed. The non-target nucleic acids can also be byproducts of amplification. Thus, the non-target nucleic acids can include both non-target nucleic acids from the original sample, lysed or unlysed, and from an amplified sample. The presence of a large amount of non-target nucleic acids, an activated programmable nuclease may be inhibited in its ability to bind and cleave the reporter sequences. This is because the activated programmable nucleases collaterally cleaves any nucleic acids. If total nucleic acids are in present in large amounts, they may outcompete reporters for the programmable nucleases. The devices and methods disclosed herein are designed to have an excess of reporter to total nucleic acids, such that the detectable signals from cleavage reactions (e.g., DETECTR reactions) are particularly superior. In some embodiments, the reporter can be present in at least 1.5 fold, at least 2 fold, at least 3 fold, at least 4 fold, at least 5 fold, at least 6 fold, at least 7 fold, at least 8 fold, at least 9 fold, at least 10 fold, at least 11 fold, at least 12 fold, at least 13 fold, at least 14 fold, at least 15 fold, at least 16 fold, at least 17 fold, at least 18 fold, at least 19 fold, at least 20 fold, at least 30 fold, at least 40 fold, at least 50 fold, at least 60 fold, at least 70 fold, at least 80 fold, at least 90 fold, at least 100 fold, from 1.5 fold to 100 fold, from 2 fold to 10 fold, from 10 fold to 20 fold, from 20 fold to 30 fold, from 30 fold to 40 fold, from 40 fold to 50 fold, from 50 fold to 60 fold, from 60 fold to 70 fold, from 70 fold to 80 fold, from 80 fold to 90 fold, from 90 fold to 100 fold, from 1.5 fold to 10 fold, from 1.5 fold to 20 fold, from 10 fold to 40 fold, from 20 fold to 60 fold, or from 10 fold to 80 fold excess of total nucleic acids.

A second significant advantage of the devices and methods disclosed herein is the design of an excess volume comprising the guide nucleic acid, the programmable nuclease, and the reporter, which contacts a smaller volume comprising the sample with the target nucleic acid of interest. The smaller volume comprising the sample can be unlysed sample, lysed sample, or lysed sample which has undergone any combination of reverse transcription, amplification, and in vitro transcription. The presence of various reagents in a crude, non-lysed sample, a lysed sample, or a lysed and amplified sample, such as buffer, magnesium sulfate, salts, the pH, a reducing agent, primers, dNTPs, NTPs, cellular lysates, non-target nucleic acids, primers, or other components, can inhibit the ability of the programmable nuclease to find and cleave the nucleic acid of the reporter. This may be due to nucleic acids that are not the reporter, which outcompete the nucleic acid of the reporter, for the programmable nuclease. Alternatively, various reagents in the sample may simply inhibit the activity of the programmable nuclease. Thus, the devices and methods provided herein for contacting an excess volume comprising the guide nucleic acid, the programmable nuclease, and the reporter to a smaller volume comprising the sample with the target nucleic acid of interest provides for superior detection of the target nucleic acid by ensuring that the programmable nuclease is able to find and cleaves the nucleic acid of the reporter. In some embodiments, the volume comprising the guide nucleic acid, the programmable nuclease, and the reporter (can be referred to as "a second volume") is 4-fold greater than a volume comprising the sample (can be referred to as "a first volume"). In some embodiments, the volume comprising the guide nucleic acid, the programmable nuclease, and the reporter (can be referred to as "a second volume") is at least 1.5 fold, at least 2 fold, at least 3 fold, at least 4 fold, at least 5 fold, at least 6 fold, at least 7 fold, at least 8 fold, at least 9 fold, at least 10 fold, at least 11 fold, at least 12 fold, at least 13 fold, at least 14 fold, at least 15 fold, at least 16 fold, at least 17 fold, at least 18 fold, at least 19 fold, at least 20 fold, at least 30 fold, at least 40 fold, at least 50 fold, at least 60 fold, at least 70 fold, at least 80 fold, at least 90 fold, at least 100 fold, from 1.5 fold to 100 fold, from 2 fold to 10 fold, from 10 fold to 20 fold, from 20 fold to 30 fold, from 30 fold to 40 fold, from 40 fold to 50 fold, from 50 fold to 60 fold, from 60 fold to 70 fold, from 70 fold to 80 fold, from 80 fold to 90 fold, from 90 fold to 100 fold, from 1.5 fold to 10 fold, from 1.5 fold to 20 fold, from 10 fold to 40 fold, from 20 fold to 60 fold, or from 10 fold to 80 fold greater than a volume comprising the sample (can be referred to as "a first volume"). In some embodiments, the volume comprising the sample is at least 0.5 ul, at least 1 ul, at least at least 1 uL, at least 2 uL, at least 3 uL, at least 4 uL, at least 5 uL, at least 6 uL, at least 7 uL, at least 8 uL, at least 9 uL, at least 10 uL, at least 11 uL, at least 12 uL, at least 13 uL, at least 14 uL, at least 15 uL, at least 16 uL, at least 17 uL, at least 18 uL, at least 19 uL, at least 20 uL, at least 25 uL, at least 30 uL, at least 35 uL, at least 40 uL, at least 45 uL, at least 50 uL, at least 55 uL, at least 60 uL, at least 65 uL, at least 70 uL, at least 75 uL, at least 80 uL, at least 85 uL, at least 90 uL, at least 95 uL, at least 100 uL, from 0.5 uL to 5 ul uL, from 5 uL to 10 uL, from 10 uL to 15 uL, from 15 uL to 20 uL, from 20 uL to 25 uL, from 25 uL to 30 uL, from 30 uL to 35 uL, from 35 uL to 40 uL, from 40 uL to 45 uL, from 45 uL to 50 uL, from 10 uL to 20 uL, from 5 uL to 20 uL, from 1 uL to 40 uL, from 2 uL to 10 uL, or from 1 uL to 10 uL. In some embodiments, the volume comprising the programmable nuclease, the guide nucleic acid, and the reporter is at least 10 uL, at least 11 uL, at least 12 uL, at least 13 uL, at least 14 uL, at least 15 uL, at least 16 uL, at least 17 uL, at least 18 uL, at least 19 uL, at least 20 uL, at least 21 uL, at least 22 uL, at least 23 uL, at least 24 uL, at least 25 uL, at least 26 uL, at least 27 uL, at least 28 uL, at least 29 uL, at least 30 uL, at least 40 uL, at least 50 uL, at least 60 uL, at least 70 uL, at least 80 uL, at least 90 uL, at least 100 uL, at least 150 uL, at least 200 uL, at least 250 uL, at least 300 uL, at least 350 uL, at least 400 uL, at least 450 uL, at least 500 uL, from 10 uL to 15 ul uL, from 15 uL to 20 uL, from 20 uL to 25 uL, from 25 uL to 30 uL, from 30 uL to 35 uL, from 35 uL to 40 uL, from 40 uL to 45 uL, from 45 uL to 50 uL, from 50 uL to 55 uL, from 55 uL to 60 uL, from 60 uL to 65 uL, from 65 uL to 70 uL, from 70 uL to 75 uL, from 75 uL to 80 uL, from 80 uL to 85 uL, from 85 uL to 90 uL, from 90 uL to 95 uL, from 95 uL to 100 uL, from 100 uL to 150 uL, from 150 uL to 200 uL, from 200 uL to 250 uL, from 250 uL to 300 uL, from 300 uL to 350 uL, from 350 uL to 400 uL, from 400 uL to 450 uL, from 450 uL to 500 uL, from 10 uL to 20 uL, from 10 uL to 30 uL, from 25 uL to 35 uL, from 10 uL to 40 uL, from 20 uL to 50 uL, from 18 uL to 28 uL, or from 17 uL to 22 uL.

A reporter may be a hybrid nucleic acid reporter. A hybrid nucleic acid reporter comprises a nucleic acid with at least one deoxyribonucleotide and at least one ribonucleotide. In some embodiments, the nucleic acid of the hybrid nucleic acid reporter can be of any length and can have any mixture of DNAs and RNAs. For example, in some cases, longer stretches of DNA can be interrupted by a few ribonucleotides. Alternatively, longer stretches of RNA can be interrupted by a few deoxyribonucleotides. Alternatively, every other base in the nucleic acid may alternate between ribonucleotides and deoxyribonucleotides. A major advantage of the hybrid nucleic acid reporter is increased stability as compared to a pure RNA nucleic acid reporter. For example, a hybrid nucleic acid reporter can be more stable in solution, lyophilized, or vitrified as compared to a pure DNA or pure RNA reporter.

The reporter can be lyophilized or vitrified. The reporter can be suspended in solution or immobilized on a surface. For example, the reporter can be immobilized on the surface of a chamber in a device as disclosed herein. In some cases, the reporter is immobilized on beads, such as magnetic beads, in a chamber of a device as disclosed herein where they are held in position by a magnet placed below the chamber.

Signals

The devices, systems, fluidic devices, kits, and methods for detecting the presence of a target nucleic acid in a sample described herein may comprise a generation of a signal in response to the presence or absence of the target nucleic acid in the sample. The generation of a signal in response to the presence or absence of the target nucleic acid in the sample as described herein is compatible with the methods and devices described herein (e.g., pneumatic valve devices, sliding valve devices, rotating valve devices, and lateral flow devices) and may be result form the use of compositions disclosed herein (e.g., programmable nucleases, guide nucleic acids, reagents for in vitro transcription, reagents for amplification, reagents for reverse transcription, reporters, or any combination thereof) to carry out highly efficient, rapid, and accurate reactions for detecting whether a target nucleic acid is present in a sample (e.g., DETECTR reactions). As disclosed herein, detecting the presence or absence of a target nucleic acid of interest involves measuring a signal emitted from a detection moiety present in a reporter, after cleavage of the reporter by an activated programmable nuclease. Thus, the detecting steps disclosed herein involve measuring the presence of a target nucleic acid, quantifying how much of the target nucleic acid is present, or, measuring a signal indicating that the target nucleic acid is absent in a sample. In some embodiments, a signal is generated upon cleavage of the detector nucleic acid by the programmable nuclease. In other embodiments, the signal changes upon cleavage of the detector nucleic acid by the programmable nuclease. In other embodiments, a signal may be present in the absence of detector nucleic acid cleavage and disappear upon cleavage of the target nucleic acid by the programmable nuclease. For example, a signal may be produced in a microfluidic device or lateral flow device after contacting a sample with a composition comprising a programmable nuclease.

Often, the signal is a colorimetric signal or a signal visible by eye. In some instances, the signal is fluorescent, electrical, chemical, electrochemical, or magnetic. A signal can be a calorimetric, potentiometric, amperometric, optical (e.g., fluorescent, colorometric, etc.), or piezo-electric signal. In some cases, the detectable signal is a colorimetric signal or a signal visible by eye. In some instances, the detectable signal is fluorescent, electrical, chemical, electrochemical, or magnetic. In some cases, the first detection signal is generated by binding of the detection moiety to the capture molecule in the detection region, where the first detection signal indicates that the sample contained the target nucleic acid. Sometimes the system is capable of detecting more than one type of target nucleic acid, wherein the system comprises more than one type of guide nucleic acid and more than one type of detector nucleic acid. In some cases, the detectable signal is generated directly by the cleavage event. Alternatively or in combination, the detectable signal is generated indirectly by the signal event. Sometimes the detectable signal is not a fluorescent signal. In some instances, the detectable signal is a colorimetric or color-based signal. In some cases, the detected target nucleic acid is identified based on its spatial location on the detection region of the support medium. In some cases, the second detectable signal is generated in a spatially distinct location than the first generated signal.

Buffers

The reagents described herein can also include buffers, which are compatible with the devices, systems, fluidic devices, kits, and methods disclosed herein. The buffers described herein are compatible for use in the devices described herein (e.g., pneumatic valve devices, sliding valve devices, rotating valve devices, and lateral flow devices) and may be used in conjunction with compositions disclosed herein (e.g., programmable nucleases, guide nucleic acids, reagents for in vitro transcription, reagents for amplification, reagents for reverse transcription, reporters, or any combination thereof) to carry out highly efficient, rapid, and accurate reactions for detecting whether the target nucleic acid is in the sample (e.g., DETECTR reactions). These buffers are compatible with the other reagents, samples, and support mediums as described herein for detection of an ailment, such as a disease, cancer, or genetic disorder, or genetic information, such as for phenotyping, genotyping, or determining ancestry. The methods described herein can also include the use of buffers, which are compatible with the methods disclosed herein. For example, a buffer comprises 20 mM HEPES pH 6.8, 50 mM KCl, 5 mM $MgCl_2$, and 5% glycerol. In some instances the buffer comprises from 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 10 to 20, 10 to 30, 10 to 40, 10 to 50, 15 to 20, 15 to 25, 15 to 30, 15 to 4, 15 to 50, 20 to 25, 20 to 30, 20 to 40, or 20 to 50 mM HEPES pH 6.8. The buffer can comprise to 0 to 500, 0 to 400, 0 to 300, 0 to 250, 0 to 200, 0 to 150, 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 5 to 150, 5 to 200, 5 to 250, 5 to 300, 5 to 400, 5 to 500, 25 to 50, 25 to 75, 25 to 100, 50 to 100, 50 150, 50 to 200, 50 to 250, 50 to 300, 100 to 200, 100 to 250, 100 to 300, or 150 to 250 mM KCl. In other instances the buffer comprises 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 10 to 20, 10 to 30, 10 to 40, 10 to 50, 15 to 20, 15 to 25, 15 to 30, 15 to 4, 15 to 50, 20 to 25, 20 to 30, 20 to 40, or 20 to 50 mM $MgCl_2$. The buffer can comprise 0 to 25, 0 to 20, 0 to 10, 0 to 5, 5 to 10, 5 to 15, 5 to 20, 5 to 25, 5 to 30% glycerol. The buffer can comprise from 0% to 30%, from 5% to 30%, from 10% to 30%, from 15% to 30%, from 20% to 30%, from 25% to 30%, from 0% to 25%, from 2% to 25%, from 5% to 25%, from 10% to 25%, from 15% to 25%, from 20% to 25%, from 0% to 20%, from 5% to 20%, from 10% to 20%, from 15% to 20%, from 0% to 15%, from 5% to 15%, from 10% to 15%, from 0% to 10%, from 5% to 10%, or from 0% to 5% glycerol.

As another example, a buffer comprises 100 mM Imidazole pH 7.5; 250 mM KCl, 25 mM $MgCl_2$, 50 ug/mL BSA, 0.05% Igepal Ca-630, and 25% Glycerol. In some instances the buffer comprises 0 to 500, 0 to 400, 0 to 300, 0 to 250, 0 to 200, 0 to 150, 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 5 to 150, 5 to 200, 5 to 250, 5 to 300, 5 to 400, 5 to 500, 25 to 50, 25 to 75, 25 to 100, 50 to 100, 50 150, 50 to 200, 50 to 250, 50 to 300, 100 to 200, 100 to 250, 100 to 300, or 150 to 250 mM Imidazole pH 7.5. In some instances the buffer comprises from 50 mM to 500 mM, from 150 mM to 500 mM, from 200 mM to 500 mM, from 250 mM to 500 mM, from 300 mM to 500 mM, from 350 mM to 500 mM, from 400 mM to 500 mM, from 450 mM to 500 mM, from 0 mM to 450 mM, from 50 mM to 450 mM, from 150 mM to 450 mM, from 200 mM to 450 mM, from 250 mM to 450 mM, from 300 mM to 450 mM, from 350 mM to 450 mM, from 400 mM to 450 mM, from 0 mM to 400 mM, from 50 mM to 400 mM, from 150 mM to 400 mM, from 200 mM to 400 mM, from 250 mM to 400 mM, from 300 mM to 400 mM, from 350 mM to 400 mM, from 0 mM to 350 mM, from 50 mM to 350 mM, from 150 mM to 350 mM, from 200 mM to 350 mM, from 250 mM to 350 mM, from 300 mM to 350 mM, from 0 mM to 300 mM, from 50 mM to 300 mM, from 150 mM to 300 mM, from 200 mM to 300 mM, from 250 mM to 300 mM, from 50 mM to 250 mM, from 150 mM to 250 mM, from 200 mM to 250 mM, from 50 mM to 200 mM, from 150 mM to 200 mM, from 50 mM to 150 mM, from 100 mM to 150 mM, from 50 mM to 100 mM Imidazole pH 7.5. The buffer can comprise 0 to 500, 0 to 400, 0 to 300, 0 to 250, 0 to 200, 0 to 150, 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 5 to 150, 5 to 200, 5 to 250, 5 to 300, 5 to 400, 5 to 500, 25 to 50, 25 to 75, 25 to 100, 50 to 100, 50 150, 50 to 200, 50 to 250, 50 to 300, 100 to 200, 100 to 250, 100 to 300, or 150 to 250 mM KCl. In other instances the buffer comprises 0 to 100, 0 to 75, 0 to 50, 0 to 25, 0 to 20, 0 to 10, 0 to 5, 5 to 10, 5 to 15, 5 to 20, 5 to 25, to 30, 5 to 40, 5 to 50, 5 to 75, 5 to 100, 10 to 20, 10 to 30, 10 to 40, 10 to 50, 15 to 20, 15 to 25, 15 to 30, 15 to 4, 15 to 50, 20 to 25, 20 to 30, 20 to 40, or 20 to 50 mM $MgCl_2$. The buffer, in some instances, comprises 0 to 100, 0 to 75, 0 to 50, 0 to 25, 0 to 20, 0 to 10, 0 to 5, 5 to 50, 5 to 75, 5 to 100, 10 to 20, 10 to 50, 10 to 75, 10 to 100, 25 to 50, 25 to 75 25 to 100, 50 to 75, or 50 to 100 ug/mL BSA. In some instances, the buffer comprises 0 to 1, 0 to 0.5, 0 to 0.25, 0 to 0.01, 0 to 0.05, 0 to 0.025, 0 to 0.01, 0.01 to 0.025, 0.01 to 0.05, 0.01 to 0.1, 0.01 to 0.25, 0.01, to 0.5, 0.01 to 1, 0.025 to 0.05, 0.025 to 0.1, 0.025, to 0.5, 0.025 to 1, 0.05 to 0.1, 0.05 to 0.25, 0.05 to 0.5, 0.05 to 0.75, 0.05 to 1, 0.1 to 0.25, 0.1 to 0.5, or 0.1 to 1% Igepal Ca-630. The buffer can comprise 0 to 25, 0 to 20, 0 to 10, 0 to 5, 5 to 10, 5 to 15, 5 to 20, 5 to 25, 5 to 30% glycerol. The buffer can comprise from 0% to 30%, from 5% to 30%, from 10% to 30%, from 15% to 30%, from 20% to 30%, from 25% to 30%, from 0% to 25%, from 2% to 25%, from 5% to 25%, from 10% to 25%, from 15% to 25%, from 20% to 25%, from 0% to 20%, from 5% to 20%, from 10% to 20%, from 15% to 20%, from 0% to 15%, from 5% to 15%, from 10% to 15%, from 0% to 10%, from 5% to 10%, or from 0% to 5% glycerol.

Stability

The reagents, compositions, and kits disclosed herein may comprise stable compositions and reagents. These stable compositions and reagents as described herein are compatible with the methods and devices described herein (e.g., pneumatic valve devices, sliding valve devices, rotating valve devices, and lateral flow devices) and may be compositions disclosed herein (e.g., programmable nucleases, guide nucleic acids, reagents for in vitro transcription, reagents for amplification, reagents for reverse transcription, reporters, or any combination thereof) to carry out highly efficient, rapid, and accurate reactions for detecting whether a target nucleic acid is present in a sample (e.g., DETECTR reactions). Disclosed herein are stable compositions of the reagents and the programmable nuclease system for use in the methods as discussed herein. The reagents and programmable nuclease system described herein may be stable in various storage conditions including refrigerated, ambient, and accelerated conditions. Disclosed herein are stable reagents. The stability may be measured for the reagents and programmable nuclease system themselves or the reagents and programmable nuclease system present on the support medium.

In some instances, stable as used herein refers to a reagents having about 5% w/w or less total impurities at the end of a given storage period. Stability may be assessed by HPLC or any other known testing method. The stable reagents may have about 10% w/w, about 5% w/w, about 4% w/w, about 3% w/w, about 2% w/w, about 1% w/w, or about 0.5% w/w total impurities at the end of a given storage period. The stable reagents may have from 0.5% w/w to 10% w/w, from 1% w/w to 8% w/w, from 2% w/w to 7% w/w, or from 3% w/w to 5% w/w total impurities at the end of a given storage period.

In some embodiments, stable as used herein refers to a reagents and programmable nuclease system having about 10% or less loss of detection activity at the end of a given storage period and at a given storage condition. Detection activity can be assessed by known positive sample using a known method. Alternatively or combination, detection activity can be assessed by the sensitivity, accuracy, or specificity. In some embodiments, the stable reagents has about 10%, about 9%, about 8%, about 7%, about 6%, about 5%, about 4%, about 3%, about 2%, about 1%, or about 0.5% loss of detection activity at the end of a given storage period. In some embodiments, the stable reagents has from 0.5% to 10%, from 1% to 8%, from 2% to 7%, or from 3% to 5% loss of detection activity at the end of a given storage period.

In some embodiments, the stable composition has zero loss of detection activity at the end of a given storage period and at a given storage condition. The given storage condition may comprise humidity of equal to or less than 10%, 20%, 30%, 40%, 50%, 60%, 70%, 80%, 90%, or 100% relative humidity. The controlled storage environment may comprise humidity from 0% to 50% relative humidity, from 0% to 40% relative humidity, from 0% to 30% relative humidity, from 0% to 20% relative humidity, or from 0% to 10% relative humidity. The controlled storage environment may comprise humidity from 10% to 80%, from 10% to 70%, from 10% to 60%, from 20% to 50%, from 20% to 40%, or from 20% to 30% relative humidity. The controlled storage environment may comprise temperatures of about $-100°$ C., about $-80°$ C., about $-20°$ C., about $4°$ C., about $25°$ C. (room temperature), or about $40°$ C. The controlled storage environment may comprise temperatures from $-80°$ C. to $25°$ C., or from $-100°$ C. to $40°$ C. The controlled storage environment may comprise temperatures from $-20°$ C. to $40°$ C., from $-20°$ C. to $4°$ C., or from $4°$ C. to $40°$ C. The controlled storage environment may protect the system or kit from light or from mechanical damage. The controlled storage environment may be sterile or aseptic or maintain the sterility of the light conduit. The controlled storage environment may be aseptic or sterile.

Multiplexing

The devices, systems, fluidic devices, kits, and methods described herein can be multiplexed in a number of ways. These methods of multiplexing are, for example, consistent with fluidic devices disclosed herein for detection of a target nucleic acid within the sample, wherein the fluidic device may comprise multiple pumps, valves, reservoirs, and chambers for sample preparation, amplification of a target nucleic acid within the sample, mixing with a programmable nuclease, and detection of a detectable signal arising from cleavage of detector nucleic acids by the programmable nuclease within the fluidic system itself.

Methods consistent with the present disclosure include a multiplexing method of assaying for a target nucleic acid in a sample. A multiplexing method comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal indicates an absence of the target nucleic acid in the sample. As another example, multiplexing method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal indicates an absence of the target nucleic acid in the sample. Often, the substrate is an enzyme-nucleic acid. Sometimes, the substrate is an enzyme substrate-nucleic acid.

Multiplexing can be either spatial multiplexing wherein multiple different target nucleic acids at the same time, but the reactions are spatially separated. Often, the multiple target nucleic acids are detected using the same programmable nuclease, but different guide nucleic acids. The multiple target nucleic acids sometimes are detected using the different programmable nucleases. In the case wherein multiple target nucleic acids are detected using the different programmable nucleases, the method involves using a first programmable nuclease, which upon activation (e.g., after binding of a first guide nucleic acid to a first target), cleaves a nucleic acid of a first reporter and a second programmable nuclease, which upon activation (e.g., after binding of a second guide nucleic acid to a second target), cleaves a nucleic acid of a second reporter. For example, the first programmable nuclease can be a Cas13 nuclease, which upon activation, cleaves an RNA of a first reporter and the second programmable nuclease can be a Cas12 nuclease, which upon activation, cleaves a DNA of a second reporter. In some embodiments, a pair of orthogonal Cas13a proteins can be used. For example, a first Cas13a protein in the orthogonal pair has a preference for cleaving a first nucleotide-rich nucleic acid in a first reporter and a second Cas13a protein in the orthogonal pair has a preference for cleaving a second nucleotide-rich nucleic acid in a second reporter, wherein the first nucleotide and the second nucleotide are different. One example of an orthogonal pair is LbaCas13a, which has a preference for cleaving an A-rich nucleic acid, and LbuCas13a, which has a preference for cleaving a U-rich nucleic acid. Orthogonal pairs of Cas13s can be LbaCas13a (A) and HheCas13a (U), LbaCas13a (A) and RcaCas13a (U), LbaCas13a (A) and PprCas13a (U), LbaCas13a (A) and LneCas13a (U), LbaCas13a (A) and LbuCas13a (U), LbaCas13a (A) and LwaCas13a (U), LbaCas13a (A) and LshCas13a (U), EreCas13a (A) and HheCas13a (U), EreCas13a (A) and RcaCas13a (U), EreCas13a (A) and PprCas13a (U), EreCas13a (A) and LneCas13a (U), EreCas13a (A) and LbuCas13a (U), EreCas13a (A) and LwaCas13a (U), EreCas13a (A) and LshCas13a (U), EreCas13a (A) and LseCas13a (U), CamCas13a (A) and HheCas13a (U), CamCas13a (A) and RcaCas13a (U), CamCas13a (A) and PprCas13a (U), CamCas13a (A) and LneCas13a (U), CamCas13a (A) and LbuCas13a (U), CamCas13a (A) and LwaCas13a (U), CamCas13a (A) and LshCas13a (U), CamCas13a (A) and LseCas13a (U), wherein the preference of nucleotide in the nucleic acid of the reporter is specified in parentheses. Sometimes, multiplexing can be single reaction multiplexing wherein multiple different target acids are detected in a single reaction volume. Often, at least two different programmable nucleases are used in single reaction multiplexing. For example, multiplexing can be enabled by immobilization of multiple categories of detector nucleic acids within a fluidic system, to enable detection of multiple target nucleic acids within a single fluidic system. Multiplexing allows for detection of multiple target nucleic acids in one kit or system. In some cases, the multiple target nucleic acids comprise different target nucleic acids to a virus, a *bacterium*, or a pathogen responsible for one disease. In some cases, the multiple target nucleic acids comprise different target nucleic acids associated with a cancer or genetic disorder. Multiplexing for one disease, cancer, or genetic disorder increases at least one of sensitivity, specificity, or accuracy of the assay to detect the presence of the disease in the sample. In some cases, the multiple target nucleic acids comprise target nucleic acids directed to different viruses, bacteria, or pathogens responsible for more than one disease. In some cases, multiplexing allows for discrimination between multiple target nucleic acids, such as target nucleic acids that comprise different genotypes of the same bacteria or pathogen responsible for a disease, for example, for a wild-type genotype of a bacteria or pathogen and for genotype of a bacteria or pathogen comprising a mutation, such as a single nucleotide polymorphism (SNP) that can confer resistance to a treatment, such as antibiotic treatment. Multiplexing, thus, allows for multiplexed detection of multiple genomic alleles. For example, multiplexing comprises method of assaying comprising a single assay for a microorganism species using a first programmable nuclease and an antibiotic resistance pattern in a microorganism using a second programmable nuclease. Sometimes, multiplexing allows for discrimination between multiple target nucleic acids of different HPV strains, for example, HPV16 and HPV18. In some cases, the multiple target nucleic acids comprise target nucleic acids directed to different cancers or genetic disorders. Often, multiplexing allows for discrimination between multiple target nucleic acids, such as target nucleic acids that comprise different genotypes, for example, for a wild-type genotype and for SNP genotype. Multiplexing for multiple diseases, cancers, or genetic disorders provides the capability to test a panel of diseases from a single sample. For example, multiplexing for multiple diseases can be valuable in a broad panel testing of a new patient or in epidemiological surveys. Often multiplexing is used for identifying bacterial pathogens in sepsis or other diseases associated with multiple pathogens.

Furthermore, signals from multiplexing can be quantified. For example, a method of quantification for a disease panel comprises assaying for a plurality of unique target nucleic acids in a plurality of aliquots from a sample, assaying for a control nucleic acid control in a second aliquot of the sample, and quantifying a plurality of signals of the plurality of unique target nucleic acids by measuring signals produced by cleavage of detector nucleic acids compared to the signal produced in the second aliquot. In this context, a unique target nucleic acid refers to the sequence of a nucleic acid that has an at least one nucleotide difference from the sequences of the other nucleic acids in the plurality. Multiple copies of each target nucleic acid may be present. For example, a unique target nucleic population may comprise multiple copies of the unique target nucleic acid. Often the plurality of unique target nucleic acids are from a plurality of bacterial pathogens in the sample. Sometimes the quantification of a signal of the plurality correlates with a concentration of a unique target nucleic acid of the plurality for the unique target nucleic acid of the plurality that produced the signal of the plurality. The disease panel can be for any communicable disease, such as sepsis.

The devices, systems, fluidic devices, kits, and methods described herein can be multiplexed by various configurations of the reagents and the support medium. In some cases, the kit or system is designed to have multiple support mediums encased in a single housing. Sometimes, the multiple support mediums housed in a single housing share a single sample pad. The single sample pad may be connected to the support mediums in various designs such as a branching or a radial formation. Alternatively, each of the multiple support mediums has its own sample pad. In some cases, the kit or system is designed to have a single support medium encased in a housing, where the support medium comprises multiple detection spots for detecting multiple target nucleic acids. Sometimes, the reagents for multiplexed assays comprise multiple guide nucleic acids, multiple programmable nucleases, and multiple single stranded detector nucleic acids, where a combination of one of the guide nucleic acids, one of the programmable nucleases, and one of the single stranded detector nucleic acids detects one target nucleic acid and can provide a detection spot on the detection region. In some cases, the combination of a guide nucleic acid, a programmable nuclease, and a single stranded detector nucleic acid configured to detect one target nucleic acid is mixed with at least one other combination in a single reagent chamber. In some cases, the combination of a guide nucleic acid, a programmable nuclease, and a single stranded detector nucleic acid configured to detect one target nucleic acid is mixed with at least one other combination on a single support medium. When these combinations of reagents are contacted with the sample, the reaction for the multiple target nucleic acids occurs simultaneously in the same medium or reagent chamber. Sometimes, this reacted sample is applied to the multiplexed support medium described herein.

In some cases, the combination of a guide nucleic acid, a programmable nuclease, and a single stranded detector nucleic acid configured to detect one target nucleic acid is provided in its own reagent chamber or its own support medium. In this case, multiple reagent chambers or support mediums are provided in the device, kit, or system, where one reagent chamber is designed to detect one target nucleic acid. In this case, multiple support mediums are used to detect the panel of diseases, cancers, or genetic disorders of interest.

In some instances, the multiplexed devices, systems, fluidic devices, kits, and methods detect at least 2 different target nucleic acids in a single reaction. In some instances, the multiplexed devices, systems, fluidic devices, kits, and methods detect at least 3 different target nucleic acids in a single reaction. In some instances, the multiplexed devices, systems, fluidic devices, kits, and methods detect at least 4 different target nucleic acids in a single reaction. In some instances, the multiplexed devices, systems, fluidic devices, kits, and methods detect at least 5 different target nucleic acids in a single reaction. In some cases, the multiplexed devices, systems, fluidic devices, kits, and methods detect at least 6, 7, 8, 9, or 10 different target nucleic acids in a single reaction. In some instances, the multiplexed kits detect at least 2 different target nucleic acids in a single kit. In some instances, the multiplexed kits detect at least 3 different target nucleic acids in a single kit. In some instances, the multiplexed kits detect at least 4 different target nucleic acids in a single kit. In some instances, the multiplexed kits detect at least 5 different target nucleic acids in a single kit. In some instances, the multiplexed kits detect at least 6, 7, 8, 9, or 10 different target nucleic acids in a single kit. In some instances, the multiplexed kits detect from 2 to 10, from 3 to 10, from 4 to 10, from 5 to 10, from 6 to 10, from 7 to 10, from 8 to 10, from 9 to 10, from 2 to 9, from 3 to 9, from 4 to 9, from 5 to 9, from 6 to 9, from 7 to 9, from 8 to 9, from 2 to 8, from 3 to 8, from 4 to 8, from 5 to 8, from 6 to 8, from 7 to 8, from 2 to 7, from 3 to 7, from 4 to 7, from 5 to 7, from 6 to 7, from 2 to 6, from 3 to 6, from 4 to 6, from 5 to 6, from 2 to 5, from 3 to 5, from 4 to 5, from 2 to 4, from 3 to 4, or from 2 to 3 different target nucleic acids in a single kit. Multiplexing can be carried out in a single-pot or "one-pot" reaction, where reverse transcription, amplification, in vitro transcription, or any combination thereof, and detection are carried out in a single volume. Multiplexing can be carried out in a "two-pot reaction", where reverse transcription, amplification, in vitro transcription, or any combination thereof, are carried out in a first volume and detection is carried out in a second volume.

Detection Methods

The devices, systems, fluidic devices, kits, and methods described herein may comprise a generation of a signal in response to the presence or absence of a target nucleic acid in a sample which may be detected using detection methods described herein. The present disclosure provides methods of assaying for a target nucleic acid as described herein wherein a signal is detected. For example, a method of assaying for a target nucleic acid in a sample comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal or a presence of the signal near background indicates an absence of the target nucleic acid in the sample. As another example, a method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal or a presence of the signal near background indicates an absence of the target nucleic acid in the sample. Often, the substrate is an enzyme-nucleic acid. Sometimes, the substrate is an enzyme substrate-nucleic acid.

In some cases, the threshold of detection, for a subject method of detecting a single stranded target nucleic acid in a sample, is less than or equal to 10 nM. The term "threshold of detection" is used herein to describe the minimal amount of target nucleic acid that must be present in a sample in order for detection to occur. For example, when a threshold of detection is 10 nM, then a signal can be detected when a target nucleic acid is present in the sample at a concentration of 10 nM or more. In some cases, the threshold of detection is less than or equal to 5 nM, 1 nM, 0.5 nM, 0.1 nM, 0.05 nM, 0.01 nM, 0.005 nM, 0.001 nM, 0.0005 nM, 0.0001 nM, 0.00005 nM, 0.00001 nM, 10 pM, 1 pM, 500 fM, 250 fM, 100 fM, 50 fM, 10 fM, 5 fM, 1 fM, 500 attomolar (aM), 100 aM, 50 aM, 10 aM, or 1 aM. In some cases, the threshold of detection is in a range of from 1 aM to 1 nM, 1 aM to 500 pM, 1 aM to 200 pM, 1 aM to 100 pM, 1 aM to 10 pM, 1 aM to 1 pM, 1 aM to 500 fM, 1 aM to 100 fM, 1 aM to 1 fM, 1 aM to 500 aM, 1 aM to 100 aM, 1 aM to 50 aM, 1 aM to 10 aM, 10 aM to 1 nM, 10 aM to 500 pM, 10 aM to 200 pM, 10 aM to 100 pM, 10 aM to 10 pM, 10 aM to 1 pM, 10 aM to 500 fM, 10 aM to 100 fM, 10 aM to 1 fM, 10 aM to 500 aM, 10 aM to 100 aM, 10 aM to 50 aM, 100 aM to 1 nM, 100 aM to 500 pM, 100 aM to 200 pM, 100 aM to 100 pM, 100 aM to 10 pM, 100 aM to 1 pM, 100 aM to 500 fM, 100 aM to 100 fM, 100 aM to 1 fM, 100 aM to 500 aM, 500 aM to 1 nM, 500 aM to 500 pM, 500 aM to 200 pM, 500 aM to 100 pM, 500 aM to 10 pM, 500 aM to 1 pM, 500 aM to 500 fM, 500 aM to 100 fM, 500 aM to 1 fM, 1 fM to 1 nM, 1 fM to 500 pM, 1 fM to 200 pM, 1 fM to 100 pM, 1 fM to 10 pM, 1 fM to 1 pM, 10 fM to 1 nM, 10 fM to 500 pM, 10 fM to 200 pM, 10 fM to 100 pM, 10 fM to 10 pM, 10 fM to 1 pM, 500 fM to 1 nM, 500 fM to 500 pM, 500 fM to 200 pM, 500 fM to 100 pM, 500 fM to 10 pM, 500 fM to 1 pM, 800 fM to 1 nM, 800 fM to 500 pM, 800 fM to 200 pM, 800 fM to 100 pM, 800 fM to 10 pM, 800 fM to 1 pM, from 1 pM to 1 nM, 1 pM to 500 pM, 1 pM to 200 pM, 1 pM to 100 pM, or 1 pM to 10 pM. In some cases, the threshold of detection in a range of from 800 fM to 100 pM, 1 pM to 10 pM, 10 fM to 500 fM, 10 fM to 50 fM, 50 fM to 100 fM, 100 fM to 250 fM, or 250 fM to 500 fM. In some cases the threshold of detection is in a range of from 2 aM to 100 pM, from 20 aM to 50 pM, from 50 aM to 20 pM, from 200 aM to 5 pM, or from 500 aM to 2 pM. In some cases the threshold of detection is in a range of from 1 aM to 2 nM, from 10 aM to 2 nM, from 100 aM to 2 nM, from 1 fM to 2 nM, from 10 fM to 2 nM, from 100 fM to 2 nM, from 1 pM to 2 nM, from 10 pM to 2 nM, from 100 pM to 2 nM, from 1 aM to 200 pM, from 10 aM to 200 pM, from 100 aM to 200 pM, from 1 fM to 200 pM, from 10 fM to 200 pM, from 100 fM to 200 pM, from 1 pM to 200 pM, from 10 pM to 200 pM, from 1 aM to 20 pM, from 10 aM to 20 pM, from 100 aM to 20 pM, from 1 fM to 20 pM, from 10 fM to 20 pM, from 100 fM to 20 pM, from 1 pM to 20 pM, from 1 aM to 2 pM, from 10 aM to 2 pM, from 100 aM to 2 pM, from 1 fM to 2 pM, from 10 fM to 2 pM, from 100 fM to 2 pM, from 1 aM to 200 fM, from 10 aM to 200 fM, from 100 aM to 200 fM, from 1 fM to 200 fM, from 10 fM to 200 fM, from 1 aM to 20 fM, from 10 aM to 20 fM, from 100 aM to 20 fM, from 1 fM to 20 fM, from 1 aM to 2 fM, from 10 aM to 2 fM, from 100 aM to 2 fM, from 1 aM to 200 aM, from 10 aM to 200 aM, or from 1 aM to 20 aM. In some cases, the minimum concentration at which a single stranded target nucleic acid is detected in a sample is in a range of from 1 aM to 1 nM, 10 aM to 1 nM, 100 aM to 1 nM, 500 aM to 1 nM, 1 fM to 1 nM, 1 fM to 500 pM, 1 fM to 200 pM, 1 fM to 100 pM, 1 fM to 10 pM, 1 fM to 1 pM, 10 fM to 1 nM, 10 fM to 500 pM, 10 fM to 200 pM, 10 fM to 100 pM, 10 fM to 10 pM, 10 fM to 1 pM, 500 fM to 1 nM, 500 fM to 500 pM, 500 fM to 200 pM, 500 fM to 100 pM, 500 fM to 10 pM, 500 fM to 1 pM, 800 fM to 1 nM, 800 fM to 500 pM, 800 fM to 200 pM, 800 fM to 100 pM, 800 fM to 10 pM, 800 fM to 1 pM, 1 pM to 1 nM, 1 pM to 500 pM, from 1 pM to 200 pM, 1 pM to 100 pM, or 1 pM to 10 pM. In some cases, the minimum concentration at which a single stranded target nucleic acid is detected in a sample is in a range of from 2 aM to 100 pM, from 20 aM to 50 pM, from 50 aM to 20 pM, from 200 aM to 5 pM, or from 500 aM to 2 pM. In some cases, the minimum concentration at which a single stranded target nucleic acid is detected in a sample is in a range of from 1 aM to 2 nM, from 10 aM to 2 nM, from 100 aM to 2 nM, from 1 fM to 2 nM, from 10 fM to 2 nM, from 100 fM to 2 nM, from 1 pM to 2 nM, from 10 pM to 2 nM, from 100 pM to 2 nM, from 1 aM to 200 pM, from 10 aM to 200 pM, from 100 aM to 200 pM, from 1 fM to 200 pM, from 10 fM to 200 pM, from 100 fM to 200 pM, from 1 pM to 200 pM, from 10 pM to 200 pM, from 1 aM to 20 pM, from 10 aM to 20 pM, from 100 aM to 20 pM, from 1 fM to 20 pM, from 10 fM to 20 pM, from 100 fM to 20 pM, from 1 pM to 20 pM, from 1 aM to 2 pM, from 10 aM to 2 pM, from 100 aM to 2 pM, from 1 fM to 2 pM, from 10 fM to 2 pM, from 100 fM to 2 pM, from 1 aM to 200 fM, from 10 aM to 200 fM, from 100 aM to 200 fM, from 1 fM to 200 fM, from 10 fM to 200 fM, from 1 aM to 20 fM, from 10 aM to 20 fM, from 100 aM to 20 fM, from 1 fM to 20 fM, from 1 aM to 2 fM, from 10 aM to 2 fM, from 100 aM to 2 fM, from 1 aM to 200 aM, from 10 aM to 200 aM, or from 1 aM to 20 aM. In some cases, the minimum concentration at which a single stranded target nucleic acid can be detected in a sample is in a range of from 1 aM to 100 pM. In some cases, the minimum concentration at which a single stranded target nucleic acid can be detected in a sample is in a range of from 1 fM to 100 pM. In some cases, the minimum concentration at which a single stranded target nucleic acid can be detected in a sample is in a range of from 10 fM to 100 pM. In some cases, the minimum concentration at which a single stranded target nucleic acid can be detected in a sample is in a range of from 800 fM to 100 pM. In some cases, the minimum concentration at which a single stranded target nucleic acid can be detected in a sample is in a range of from 1 pM to 10 pM. In some cases, the devices, systems, fluidic devices, kits, and methods described herein detect a target single-stranded nucleic acid in a sample comprising a plurality of nucleic acids such as a plurality of non-target nucleic acids, where the target single-stranded nucleic acid is present at a concentration as low as 1 aM, 10 aM, 100 aM, 500 aM, 1 fM, 10 fM, 500 fM, 800 fM, 1 pM, 10 pM, 100 pM, or 1 pM.

When a guide nucleic acid binds to a target nucleic acid, the programmable nuclease's trans cleavage activity can be initiated, and detector nucleic acids can be cleaved, resulting in the detection of fluorescence. Some methods as described herein can a method of assaying for a target nucleic acid in a sample comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal or a presence of the signal near background indicates an absence of the target nucleic acid in the sample. The cleaving of the detector nucleic acid using the programmable nuclease may cleave with an efficiency of 50% as measured by a change in a signal that is calorimetric, potentiometric, amperometric, optical (e.g., fluorescent, colorometric, etc.), or piezo-electric, as non-limiting examples. Some methods as described herein can be a method of detecting a target nucleic acid in a sample comprising contacting the sample comprising the target nucleic acid with a guide nucleic acid targeting a target nucleic acid segment, a programmable nuclease capable of being activated when complexed with the guide nucleic acid and the target nucleic acid segment, a single stranded detector nucleic acid comprising a detection moiety, wherein the detector nucleic acid is capable of being cleaved by the activated programmable nuclease, thereby generating a first detectable signal, cleaving the single stranded detector nucleic acid using the programmable nuclease that cleaves as measured by a change in color, and measuring the first detectable signal on the support medium. The cleaving of the single stranded detector nucleic acid using the programmable nuclease may cleave with an efficiency of 50% as measured by a change in color. In some cases, the cleavage efficiency is at least 40%, 50%, 60%, 70%, 80%, 90%, or 95% as measured by a change in color. In some embodiments, the cleavage efficiency is from 40% to 95%, from 50% to 95%, from 60% to 95%, from 65% to 95%, from 75% to 95%, from 80% to 95%, from 90% to 95%, from 40% to 90%, from 50% to 90%, from 60% to 90%, from 65% to 90%, from 75% to 90%, from 80% to 90%, from 40% to 80%, from 50% to 80%, from 60% to 80%, from 65% to 80%, from 75% to 80%, from 40% to 75%, from 50% to 75%, from 60% to 75%, from 65% to 75%, from 40% to 60%, from 50% to 60%, or from 40% to 50% as measured by a change in color. The change in color may be a detectable colorimetric signal or a signal visible by eye. The change in color may be measured as a first detectable signal. The first detectable signal can be detectable within 5 minutes of contacting the sample comprising the target nucleic acid with a guide nucleic acid targeting a target nucleic acid segment, a programmable nuclease capable of being activated when complexed with the guide nucleic acid and the target nucleic acid segment, and a single stranded detector nucleic acid comprising a detection moiety, wherein the detector nucleic acid is capable of being cleaved by the activated nuclease. The first detectable signal can be detectable within 1, 2, 3, 4, 5, 6, 7, 8, 9, 10, 11, 12, 13, 14, 15, 20, 25, 30, 35, 40, 45, 50, 55, 60, 70, 80, 90, 100, 110, or 120 minutes of contacting the sample. In some embodiments, the first detectable signal can be detectable within from 1 to 120, from 5 to 100, from 10 to 90, from 15 to 80, from 20 to 60, or from 30 to 45 minutes of contacting the sample. In some embodiments, the first detectable signal can be detectable within from 15 minutes to 120 minutes, from 30 minutes to 120 minutes, from 45 minutes to 120 minutes, from 60 minutes to 120 minutes, from 75 minutes to 120 minutes, from 90 minutes to 120 minutes, from 105 minutes to 120 minutes, from 5 minutes to 90 minutes, from 15 minutes to 90 minutes, from 30 minutes to 90 minutes, from 45 minutes to 90 minutes, from 60 minutes to 90 minutes, from 75 minutes to 90 minutes, from 5 minutes to 75 minutes, from 15 minutes to 75 minutes, from 30 minutes to 75 minutes, from 45 minutes to 75 minutes, from 60 minutes to 75 minutes, from 5 minutes to 60 minutes, from 15 minutes to 60 minutes, from 30 minutes to 60 minutes, from 45 minutes to 60 minutes, from 5 minutes to 45 minutes, from 15 minutes to 45 minutes, from 30 minutes to 45 minutes, from 5 minutes to 30 minutes, from 15 minutes to 30 minutes, or from 5 minutes to 15 minutes.

In some cases, the devices, systems, fluidic devices, kits, and methods described herein detect a target single-stranded nucleic acid in a sample where the sample is contacted with the reagents for a predetermined length of time sufficient for the trans cleavage to occur or cleavage reaction to reach completion. In some cases, the devices, systems, fluidic devices, kits, and methods described herein detect a target single-stranded nucleic acid in a sample where the sample is contacted with the reagents for no greater than 60 minutes. Sometimes the sample is contacted with the reagents for no greater than 120 minutes, 110 minutes, 100 minutes, 90 minutes, 80 minutes, 70 minutes, 60 minutes, 55 minutes, 50 minutes, 45 minutes, 40 minutes, 35 minutes, 30 minutes, 25 minutes, 20 minutes, 15 minutes, 10 minutes, 5 minutes, 4 minutes, 3 minutes, 2 minutes, or 1 minute. Sometimes the sample is contacted with the reagents for at least 120 minutes, 110 minutes, 100 minutes, 90 minutes, 80 minutes, 70 minutes, 60 minutes, 55 minutes, 50 minutes, 45 minutes, 40 minutes, 35 minutes, 30 minutes, 25 minutes, 20 minutes, 15 minutes, 10 minutes, or 5 minutes. In some cases, the sample is contacted with the reagents for from 5 minutes to 120 minutes, from 5 minutes to 100 minutes, from 10 minutes to 90 minutes, from 15 minutes to 45 minutes, or from 20 minutes to 35 minutes. In some cases, the sample is contacted with the reagents for from 15 minutes to 120 minutes, from 30 minutes to 120 minutes, from 45 minutes to 120 minutes, from 60 minutes to 120 minutes, from 75 minutes to 120 minutes, from 90 minutes to 120 minutes, from 105 minutes to 120 minutes, from 5 minutes to 90 minutes, from 15 minutes to 90 minutes, from 30 minutes to 90 minutes, from 45 minutes to 90 minutes, from 60 minutes to 90 minutes, from 75 minutes to 90 minutes, from 5 minutes to 75 minutes, from 15 minutes to 75 minutes, from 30 minutes to 75 minutes, from 45 minutes to 75 minutes, from 60 minutes to 75 minutes, from 5 minutes to 60 minutes, from 15 minutes to 60 minutes, from 30 minutes to 60 minutes, from 45 minutes to 60 minutes, from 5 minutes to 45 minutes, from 15 minutes to 45 minutes, from 30 minutes to 45 minutes, from 5 minutes to 30 minutes, from 15 minutes to 30 minutes, or from 5 minutes to 15 minutes. In some cases, the devices, systems, fluidic devices, kits, and methods described herein can detect a target nucleic acid in a sample in less than 10 hours, less than 9 hours, less than 8 hours, less than 7 hours, less than 6 hours, less than 5 hours, less than 4 hours, less than 3 hours, less than 2 hours, less than 1 hour, less than 50 minutes, less than 45 minutes, less than 40 minutes, less than 35 minutes, less than 30 minutes, less than 25 minutes, less than 20 minutes, less than 15 minutes, less than 10 minutes, less than 9 minutes, less than 8 minutes, less than 7 minutes, less than 6 minutes, or less than 5 minutes. In some cases, the devices, systems, fluidic devices, kits, and methods described herein can detect a target nucleic acid in a sample in from 5 minutes to 10 hours, from 10 minutes to 8 hours, from 15 minutes to 6 hours, from 20 minutes to 5 hours, from 30 minutes to 10 hours, from 1 hour to 10 hours, from 2 hours to 10 hours, from 4 hours to 10 hours, from 5 hours to 10 hours, from 6 hours to 10 hours, from 8 hours to 10 hours, from 30 minutes to 8 hours, from 1 hour to 8 hours, from 2 hours to 8 hours, from 4 hours to 8 hours, from 5 hours to 8 hours, from 6 hours to 8 hours, from 30 minutes to 6 hours, from 1 hour to 6 hours, from 2 hours to 6 hours, from 4 hours to 6 hours, from 5 hours to 6 hours, from 30 minutes to 5 hours, from 1 hours to 5 hours, from 2 hours to 5 hours, from 4 hours to 5 hours, from 30 minutes to 4 hours, from 1 hour to 4 hours, from 2 hours to 4 hours, from 30 minutes to 2 hours, from 1 hour to 2 hours, from 5 minutes to 1 hour, from 15 minutes to 1 hour, from 30 minutes to 1 hour, or from 45 minutes to 1 hour.

In some cases, the devices, systems, fluidic devices, kits, and methods described herein detect a target single-stranded nucleic acid with a programmable nuclease and a single-stranded detector nucleic acid in a sample where the sample is contacted with the reagents for a predetermined length of time sufficient for trans cleavage of the single stranded detector nucleic acid. For example, a programmable nuclease is LbuCas13a that detects a target nucleic acid and a single stranded detector nucleic acid comprises two adjacent uracil nucleotides with a green detectable moiety that is detected upon cleavage. As another example, a programmable nuclease is LbaCas13a that detects a target nucleic acid and a single-stranded detector nucleic acid comprises two adjacent adenine nucleotides with a red detectable moiety that is detected upon cleavage.

In some cases, the devices, systems, fluidic devices, kits, and methods described herein detect different two target single-stranded nucleic acids with two different programmable nucleases and two different single-stranded detector nucleic acids in a sample where the sample is contacted with the reagents for a predetermined length of time sufficient for trans cleavage of the at least two single-stranded detector nucleic acids. For example, a first programmable nuclease is LbuCas13a, which is activated by a first single-stranded target nucleic acid and upon activation, cleaves a first single-stranded detector nucleic acid comprising two adjacent uracil nucleotides with a green detectable moiety that is detected upon cleavage, and a second programmable nuclease is LbaCas13a, which is activated by a second single-stranded target nucleic acid and upon activation, cleaves a second single-stranded detector nucleic acid comprising two adjacent adenine nucleotides with a red detectable moiety that is detected upon cleavage. In some cases, the activation of both programmable nucleases to cleave their respective single-stranded nucleic acids, for example LbuCas13a that cleaves a first single-stranded detector nucleic acid comprising two adjacent uracil nucleotides with a green detectable moiety that is detected upon cleavage and LbaCas13a that cleaves a second single-stranded detector nucleic acid comprises two adjacent adenine nucleotides with a red detectable moiety that is detected upon cleavage, the subsequence detection of a yellow signal indicates that the first single-stranded target nucleic acid and the second single-stranded target nucleic are present in the sample.

Alternatively, the devices, systems, fluidic devices, kits, and methods described herein can comprise a first programmable nuclease that detects the presence of a first single-stranded target nucleic acid in a sample and a second programmable nuclease that is used as a control. For example, a first programmable nuclease is Lbu13a, which cleaves a first single-stranded detector nucleic acid comprising two adjacent uracil nucleotides with a green detectable moiety that is detected upon cleavage and which is activated by a first single-stranded target nucleic acid if it is present in the sample, and a second programmable nuclease is Lba13a, which cleaves a second single-stranded detector nucleic acid comprising two adjacent adenine nucleotides with a red detectable moiety that is detected upon cleavage and which is activated by a second single-stranded target nucleic acid that is not found (and would not be expected to ever be found) in the sample and serves as a control. In this case, the detection of a red signal or a yellow signal indicates there is a problem with the test (e.g., the sample contains a high level of other RNAses that are cleaving the single-stranded detector nucleic acids in the absence of activation of the second programmable nuclease), but the detection of a green signal indicates the test is working correctly and the first target single-stranded nucleic acid of the first programmable nuclease is present in the sample.

As additional examples, the devices, systems, fluidic devices, kits, and methods described herein detect different two target single-stranded nucleic acids with two different programmable nucleases and two different single stranded detector nucleic acids in a sample where the sample is contacted with the reagents for a predetermined length of time sufficient for trans cleavage of the at least two single stranded detector nucleic acid. For example, a first programmable nuclease is a Cas13a protein, which cleaves a first single-stranded detector nucleic that is detected upon cleavage and which is activated by a first single-stranded target nucleic acid from a sepsis RNA biomarker if it is present in the sample, and a second programmable nuclease is a Cas14 protein, which cleaves a second single-stranded detector nucleic acid that is detected upon cleavage and which is activated by a second single-stranded target nucleic acid from a sepsis-causing bacteria.

A number of detection devices and methods are consistent with methods disclosed herein. For example, any device that can measure or detect a calorimetric, potentiometric, amperometric, optical (e.g., fluorescent, colorometric, etc.), or piezo-electric signal. Often a calorimetric signal is heat produced after cleavage of the detector nucleic acids. Sometimes, a calorimetric signal is heat absorbed after cleavage of the detector nucleic acids. A potentiometric signal, for example, is electrical potential produced after cleavage of the detector nucleic acids. An amperometric signal can be movement of electrons produced after the cleavage of detector nucleic acid. Often, the signal is an optical signal, such as a colorometric signal or a fluorescence signal. An optical signal is, for example, a light output produced after the cleavage of the detector nucleic acids. Sometimes, an optical signal is a change in light absorbance between before and after the cleavage of detector nucleic acids. Often, a piezo-electric signal is a change in mass between before and after the cleavage of the detector nucleic acid. Sometimes, the detector nucleic acid is protein-nucleic acid. Often, the protein-nucleic acid is an enzyme-nucleic acid.

The results from the detection region from a completed assay can be detected and analyzed in various ways, for example, by a glucometer. In some cases, the positive control spot and the detection spot in the detection region is visible by eye, and the results can be read by the user. In some cases, the positive control spot and the detection spot in the detection region is visualized by an imaging device or other device depending on the type of signal. Often, the imaging device is a digital camera, such a digital camera on a mobile device. The mobile device may have a software program or a mobile application that can capture an image of the support medium, identify the assay being performed, detect the detection region and the detection spot, provide image properties of the detection spot, analyze the image properties of the detection spot, and provide a result. Alternatively or in combination, the imaging device can capture fluorescence, ultraviolet (UV), infrared (IR), or visible wavelength signals. The imaging device may have an excitation source to provide the excitation energy and captures the emitted signals. In some cases, the excitation source can be a camera flash and optionally a filter. In some cases, the imaging device is used together with an imaging box that is placed over the support medium to create a dark room to improve imaging. The imaging box can be a cardboard box that the imaging device can fit into before imaging. In some instances, the imaging box has optical lenses, mirrors, filters, or other optical elements to aid in generating a more focused excitation signal or to capture a more focused emission signal. Often, the imaging box and the imaging device are small, handheld, and portable to facilitate the transport and use of the assay in remote or low resource settings.

The assay described herein can be visualized and analyzed by a mobile application (app) or a software program. Using the graphic user interface (GUI) of the app or program, an individual can take an image of the support medium, including the detection region, barcode, reference color scale, and fiduciary markers on the housing, using a camera on a mobile device. The program or app reads the barcode or identifiable label for the test type, locate the fiduciary marker to orient the sample, and read the detectable signals, compare against the reference color grid, and determine the presence or absence of the target nucleic acid, which indicates the presence of the gene, virus, or the agent responsible for the disease, cancer, or genetic disorder. The mobile application can present the results of the test to the individual. The mobile application can store the test results in the mobile application. The mobile application can communicate with a remote device and transfer the data of the test results. The test results can be viewable remotely from the remote device by another individual, including a healthcare professional. A remote user can access the results and use the information to recommend action for treatment, intervention, clean up of an environment.

Target Nucleic Acid Detection

The methods described herein may be used to assay for or detect the presence of a specific target nucleic acid in a sample. In some embodiments, the target nucleic acid may comprise a mutation relative to a wild type or normal genotype. The mutation may be associated with a disease phenotype, a genetic disorder, or a predisposition to a disease (e.g., cancer). The mutation may be a single nucleotide mutation, or the mutation may comprise multiple nucleotides. The mutation may comprise an insertion or a deletion of one or more nucleotides. In some embodiments, the target nucleic acid may comprise a nucleic acid from a pathogen. The pathogen may be associated with a disease or infection. The pathogen may be a virus, a *bacterium*, a protozoan, a parasite, or a fungus. The target nucleic acid may be associated with a disease trait (e.g., antibiotic resistance).

Detection of a Mutation in a Target Nucleic Acid

Disclosed herein are methods of assaying for a target nucleic acid as described herein that can be used for detection of a mutation in a target nucleic acid. For example, a method of assaying for a target nucleic acid in a sample comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal or a presence of the signal near background indicates an absence of the target nucleic acid in the sample. The detection of the signal can indicate the presence of the target nucleic acid. Sometimes, the target nucleic acid comprises a mutation. Often, the mutation is a single nucleotide mutation. As another example, a method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal or a presence of the signal near background indicates an absence of the target nucleic acid in the sample. Often, the substrate is an enzyme-nucleic acid. Sometimes, the substrate is an enzyme substrate-nucleic acid.

Methods described herein can be used to identify a mutation in a target nucleic acid. The methods can be used to identify a single nucleotide mutation of a target nucleic acid that affects the expression of a gene. A mutation that affects the expression of gene can be a single nucleotide mutation of a target nucleic acid within the gene, a single nucleotide mutation of a target nucleic acid comprising RNA associated with the expression of a gene, or a target nucleic acid comprising a single nucleotide mutation of a nucleic acid associated with regulation of expression of a gene, such as an RNA or a promoter, enhancer, or repressor of the gene. Often, a status of a mutation is used to diagnose or identify diseases associated with the mutation of target nucleic acid. Detection of target nucleic acids having a mutation are applicable to a number of fields, such as clinically, as a diagnostic, in laboratories as a research tool, and in agricultural applications. Often, the mutation is a single nucleotide mutation.

Disease Detection

Disclosed herein are methods of assaying for a target nucleic acid as described herein that can be used for disease detection. For example, a method of assaying for a target nucleic acid in a sample comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal or a presence of the signal near background indicates an absence of the target nucleic acid in the sample. The detection of the signal can indicate the presence of the target nucleic acid. Sometimes, the target nucleic acid comprises a mutation. Often, the mutation is a single nucleotide mutation. As another example, a method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal or a presence of the signal near background indicates an absence of the target nucleic acid in the sample. Often, the substrate is an enzyme-nucleic acid. Sometimes, the substrate is an enzyme substrate-nucleic acid.

The methods as described herein can be used to identify or diagnose a cancer or genetic disorder associated with a mutation in a target nucleic acid. The methods can be used to identify a mutation of a target nucleic acid that affects the expression of a cancer gene. A cancer gene can be any gene whose aberrant expression is associated with cancer, such as overexpression of an oncogene, suppression of tumor suppressor gene, or disregulation of a checkpoint inhibitor gene or gene associated with cellular growth, cellular metabolism, or the cell cycle. A mutation that affects the expression of cancer gene can be a mutation of a target nucleic acid within the cancer gene, a mutation of a target nucleic acid comprising RNA associated with the expression of a cancer gene, or a target nucleic acid comprising a mutation of a nucleic acid associated with regulation of expression of a cancer gene, such as an RNA or a promoter, enhancer, or repressor of the cancer gene. For example, a target nucleic acid comprising a mutation that affects a cancer gene can contribute to or lead to colon cancer, bladder cancer, stomach cancer, breast cancer, non-small-cell lung cancer, pancreatic cancer, esophageal cancer, cervical cancer, ovarian cancer, hepatocellular cancer, and acute myeloid leukemia. The target nucleic acid comprise a mutation of a cancer gene or RNA expressed from a cancer gene. Often, the mutation is a single nucleotide mutation.

The methods can be used to identify a mutation that affects the expression of a gene associated with a genetic disorder. A gene associated with a genetic disorder can be a gene whose overexpression is associated with a genetic disorder, from a gene associated with abnormal cellular growth resulting in a genetic disorder, or from a gene associated with abnormal cellular metabolism resulting in a genetic disorder. A mutation that affects the expression of a gene associated with a genetic disorder can be mutation within the gene associated with a genetic disorder, a mutation of RNA associated with a gene of the genetic disorder, or a mutation of a nucleic acid associated with regulation of expression of a gene associated with a genetic disorder, such as an RNA or a promoter, enhancer, or repressor of the gene associated with the genetic disorder. Often, the mutation is a single nucleotide mutation.

Methods described herein can be used to identify a mutation in a target nucleic acid from a bacteria, virus, or microbe. The methods can be used to identify a mutation of a target nucleic acid that affects the expression of a gene. A mutation that affects the expression of gene can be a mutation of a target nucleic acid within the gene, a mutation of a target nucleic acid comprising RNA associated with the expression of a gene, or a target nucleic acid comprising a mutation of a nucleic acid associated with regulation of expression of a gene, such as an RNA or a promoter, enhancer, or repressor of the gene. Sometimes, a status of a target nucleic acid mutation is used to determine a pathogenicity of a bacteria, virus, or microbe or treatment resistance, such as resistance to antibiotic treatment. Often, a status of a mutation is used to diagnose or identify diseases associated with the mutation of target nucleic acids in the bacteria, virus, or microbe. Often, the mutation is a single nucleotide mutation.

The presence or absence of a target nucleic acid may be identified in a sample, for example a biological sample. In some embodiments, the biological sample is blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. The presence or absence of the target nucleic acid may be identified using any of the methods described herein. The presence or absence of the target nucleic acid may be identified using any of the devices described herein. Once the presence or absence of a target nucleic acid has been identified in the sample, a treatment may be administered to a subject, for example the subject from whom the sample was collected. Administering treatment to the subject may comprise administering a therapy (e.g., radiation therapy, chemotherapy, antibiotics, antivirals, or antifungals). The treatment may be administered parenterally, topically, or locally. The treatment may be a treatment for a disease associated with a target nucleic acid identified in the sample. In some embodiments, the subject shows symptoms associated with a disease. In other embodiments, the subject is asymptomatic.

Detection as a Research Tool, Point-of-Care, or Over-the-Counter

Disclosed herein are methods of assaying for a target nucleic acid as described herein that can be used as a research tool, and can be provided as reagent kits. For example, a method of assaying for a target nucleic acid in a sample comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal or a presence of the signal near background indicates an absence of the target nucleic acid in the sample. The detection of the signal can indicate the presence of the target nucleic acid. Sometimes, the target nucleic acid comprises a mutation. Often, the mutation is a single nucleotide mutation. As another example, a method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal or a presence of the signal near background indicates an absence of the target nucleic acid in the sample. Often, the substrate is an enzyme-nucleic acid. Sometimes, the substrate is an enzyme substrate-nucleic acid.

The methods as described herein can be used to identify a single nucleotide mutation in a target nucleic acid. The methods can be used to identify mutation of a target nucleic acid that affects the expression of a gene. A mutation that affects the expression of gene can be a single nucleotide mutation of a target nucleic acid within the gene, a mutation of a target nucleic acid comprising RNA associated with the expression of a gene, or a target nucleic acid comprising a mutation of a nucleic acid associated with regulation of expression of a gene, such as an RNA or a promoter, enhancer, or repressor of the gene. Often, the mutation is a single nucleotide mutation.

The reagent kits or research tools can be used to detect any number of target nucleic acids, mutations, or other indications disclosed herein in a laboratory setting. Reagent kits can be provided as reagent packs for open box instrumentation.

In other embodiments, any of the systems, assay formats, Cas reporters, programmable nucleases, or other reagents can be used in a point-of-care (POC) test, which can be carried out at a decentralized location such as a hospital, POL, or clinic. These point-of-care tests can be used to diagnose any of the indications disclosed herein, such as influenza or streptococcal infections, or can be used to measure the presence or absence of a particular mutation in a target nucleic acid (e.g., EGFR). POC tests can be provided as small instruments with a consumable test card, wherein the test card is any of the assay formats (e.g., a lateral flow assay) disclosed herein.

In still other embodiments, any of the systems, assay formats, Cas reporters, programmable nucleases, or other reagents can be used in an over-the-counter (OTC), readerless format, which can be used at remote sites or at home to diagnose a range of indications. These indications can include influenza, streptococcal infections, or CT/NG infections. OTC products can include a consumable test card, wherein the test card is any of the assay formats (e.g., a lateral flow assay) disclosed herein. In an OTC product, the test card can be interpreted visually or using a mobile phone.

Detection for Agricultural Applications

Disclosed herein are methods of assaying for a target nucleic acid as described herein that can be used for agricultural applications. For example, a method of assaying for a target nucleic acid in a sample comprises contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and assaying for a signal indicating cleavage of at least some protein-nucleic acids of a population of protein-nucleic acids, wherein the signal indicates a presence of the target nucleic acid in the sample and wherein absence of the signal or a presence of the signal near background indicates an absence of the target nucleic acid in the sample. The detection of the signal can indicate the presence of the target nucleic acid. Sometimes, the target nucleic acid comprises a mutation. Often, the mutation is a single nucleotide mutation. As another example, a method of assaying for a target nucleic acid in a sample, for example, comprises: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal or a presence of the signal near background indicates an absence of the target nucleic acid in the sample. Often, the substrate is an enzyme-nucleic acid. Sometimes, the substrate is an enzyme substrate-nucleic acid.

The methods as described herein can be used to identify a mutation in a target nucleic acid of a plant or of a bacteria, virus, or microbe associated with a plant or soil. The methods can be used to identify a mutation of a target nucleic acid that affects the expression of a gene. A mutation that affects the expression of gene can be a mutation of a target nucleic acid within the gene, a mutation of a target nucleic acid comprising RNA associated with the expression of a gene, or a target nucleic acid comprising a mutation of a nucleic acid associated with regulation of expression of a gene, such as an RNA or a promoter, enhancer, or repressor of the gene. Often, the mutation is a single nucleotide mutation.

Detection of a Target Nucleic Acid in a Fluidic Device

Disclosed herein are various fluidic devices for detection of a target nucleic acid of interest in a biological sample. The fluidic devices described in detail below can be used to monitor the reaction of target nucleic acids in samples with a programmable nuclease, thereby allowing for the detection of said target nucleic acid. All samples and reagents disclosed herein are compatible for use with a fluidic device disclosed below. Any programmable nuclease, such as any Cas nuclease described herein, are compatible for use with a fluidic device disclosed below. Support mediums and housing disclosed herein are also compatible for use in conjunction with the fluidic devices disclosed below. Multiplexing detection, as described throughout the present disclosure, can be carried out within the fluidic devices disclosed herein. Compositions and methods for detection and visualization disclosed herein are also compatible for use within the below described fluidic systems.

In the below described fluidic systems, any programmable nuclease (e.g., CRISPR-Cas) reaction can be monitored. For example, any programmable nuclease disclosed herein can be used to cleave the reporter molecules to generate a detection signal. In some cases, the programmable nuclease is Cas13. Sometimes the Cas13 is Cas13a, Cas13b, Cas13c, Cas13d, or Cas13e. In some cases, the programmable nuclease is Mad7 or Mad2. In some cases, the programmable nuclease is Cas12. Sometimes the Cas12 is Cas12a, Cas12b, Cas12c, Cas12d, or Cas12e. In some cases, the programmable nuclease is Csm1, Cas9, C2c4, C2c8, C2c5, C2c10, C2c9, or CasZ. Sometimes, the Csm1 is also called smCms1, miCms1, obCms1, or suCms1. Sometimes Cas13a is also called C2c2. Sometimes CasZ is also called Cas14a, Cas14b, Cas14c, Cas14d, Cas14e, Cas14f, Cas14g, or Cas14h. Sometimes, the programmable nuclease is a type V CRISPR-Cas system. In some cases, the programmable nuclease is a type VI CRISPR-Cas system. Sometimes the programmable nuclease is a type III CRISPR-Cas system. In some cases, the programmable nuclease is from at least one of *Leptotrichia shahii* (Lsh), *Listeria seeligeri* (Lse), *Leptotrichia buccalis* (Lbu), *Leptotrichia wadei* (Lwa), *Rhodobacter capsulatus* (Rca), Herbinix hemicellulosilytica (Hhe), *Paludibacter propionicigenes* (Ppr), Lachnospiraceae *bacterium* (Lba), [*Eubacterium*] rectale (Ere), *Listeria newyorkensis* (Lny), *Clostridium aminophilum* (Cam), *Prevotella* sp. (Psm), *Capnocytophaga canimorsus* (Cca, Lachnospiraceae *bacterium* (Lba), *Bergeyella zoohelcum* (Bzo), *Prevotella intermedia* (Pin), *Prevotella buccae* (Pbu), *Alistipes* sp. (Asp), *Riemerella anatipestifer* (Ran), *Prevotella aurantiaca* (Pau), *Prevotella saccharolytica* (Psa), *Prevotella intermedia* (Pint), *Capnocytophaga canimorsus* (Cca), *Porphyromonas gulae* (Pgu), *Prevotella* sp. (Psp), *Porphyromonas gingivalis* (Pig), *Prevotella intermedia* (Ping), *Enterococcus italicus* (Ei), *Lactobacillus salivarius* (Ls), or *Thermus thermophilus* (Tt). Sometimes the Cas13 is at least one of LbuCas13a, LwaCas13a, LbaCas13a, HheCas13a, PprCas13a, EreCas13a, CamCas13a, or LshCas13a.

Figure 9:
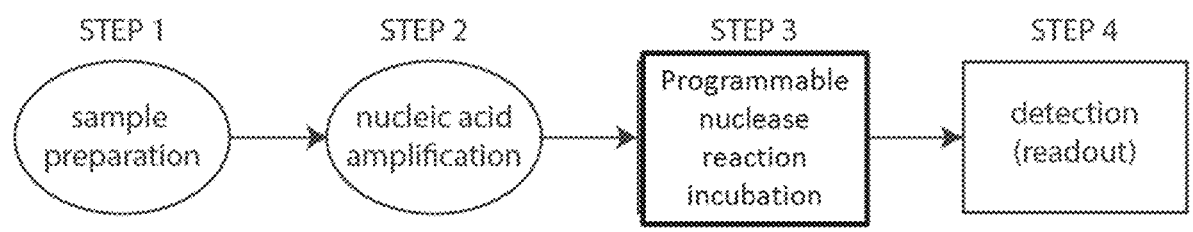
FIG. 9 shows a schematic illustrating a workflow of a CRISPR-Cas reaction. Step 1 shown in the workflow is sample preparation. Step 2 shown in the workflow is nucleic acid amplification. Step 3 shown in the workflow is Cas reaction incubation. Step 4 shown in the workflow is detection (readout). Non-essential steps are shown as oval circles. Steps 1 and 2 are not essential, and steps 3 and 4 can occur concurrently, if detection and readout are incorporated to the CRISPR reaction.

A workflow of a method for detecting a target nucleic acid in a sample within a fluidic device can include sample preparation, nucleic acid amplification, incubation with a programmable nuclease, and/or detection (readout). FIG. 9 shows a schematic illustrating a workflow of a programmable nuclease reaction. Step 1 shown in the workflow is sample preparation, Step 2 shown in the workflow is nucleic acid amplification. Step 3 shown in the workflow is programmable nuclease incubation. Step 4 shown in the workflow is detection (readout). Non-essential steps are shown as oval circles. Steps 1 and 2 are optional, and steps 3 and 4 can occur concurrently, if incubation and detection of programmable nuclease activity are within the same chamber. Sample preparation and amplification can be carried out within a fluidic device described herein or, alternatively, can be carried out prior to introduction into the fluidic device. As mentioned above, sample preparation of any nucleic acid amplification are optional, and can be excluded. In further cases, programmable nuclease reaction incubation and detection (readout) can be performed sequentially (one after another) or concurrently (at the same time). In some embodiments, sample preparation and/or amplification can be performed within a first fluidic device and then the sample can be transferred to a second fluidic device to carry out Steps 3 and 4 and, optionally, Step 2.

Workflows and systems compatible with the compositions and methods provided herein include one-pot reactions and two-pot reactions. In a one-pot reaction, amplification, reverse transcription, amplification and reverse transcription, or amplification and in vitro transcription, and detection can be carried out simultaneously in one chamber. In other words, in a one-pot reaction, any combination of reverse transcription, amplification, and in vitro transcription can be performed in the same reaction as detection. In a two-pot reaction, any combination of reverse transcription, amplification, and in vitro transcription can be performed in a first reaction, followed by detection in a second reaction. The one-pot or two-pot reactions can be carried out in any of the chambers of the devices disclosed herein.

Figure 10:
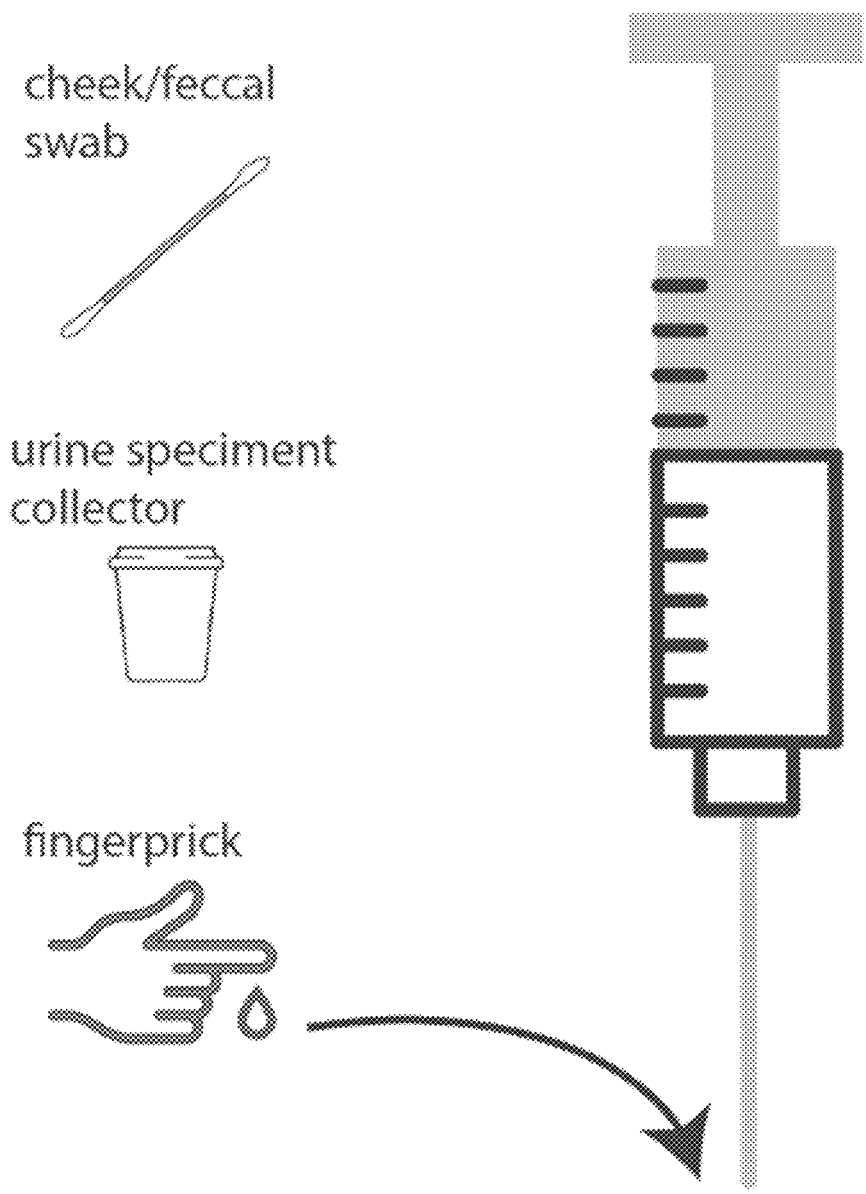
FIG. 10 shows an example fluidic device for sample preparation that may be used in Step 1 of the workflow schematic of FIG. 9. The sample preparation fluidic device shown in this figure can process different types of biological sample: finger-prick blood, urine, or swabs with fecal, cheek, or other collection.

A fluidic device for sample preparation can be referred to as a filtration device. In some embodiments, the filtration device for sample preparation resembles a syringe or, comprises, similar functional elements to a syringe. For example, a functional element of the filtration device for sample preparation includes a narrow tip for collection of liquid samples. Liquid samples can include blood, saliva, urine, or any other biological fluid. Liquid samples can also include liquid tissue homogenates. The tip, for collection of liquid samples, can be manufactured from glass, metal, plastic, or other biocompatible materials. The tip may be replaced with a glass capillary that may serve as a metering apparatus for the amount of biological sample added downstream to the fluidic device. For some samples, e.g., blood, the capillary may be the only fluidic device required for sample preparation. Another functional element of the filtration device for sample preparation may include a channel that can carry volumes from nL to mL, containing lysis buffers compatible with the programmable nuclease reaction downstream of this process. The channel may be manufactured from metal, plastic, or other biocompatible materials. The channel may be large enough to hold an entire fecal, buccal, nasal, or other biological sample collection swab. The filtration device may further contain a solution of reagents that will lyse the cells in each type of samples and release the nucleic acids so that they are accessible to the programmable nuclease. Active ingredients of the solution may be chaotropic agents, detergents, salts, and can be of high osmolality, ionic strength and pH. Chaotropic agents or chaotropes are substances that disrupt the three-dimensional structure in macromolecules such as proteins, DNA, or RNA. One example protocol comprises a 4 M guanidinium isothiocyanate, 25 mM sodium citrate.$2H_2O$, 0.5% (w/v) sodium lauryl sarcosinate, and 0.1 M β-mercaptoethanol), but numerous commercial buffers for different cellular targets may also be used. Alkaline buffers may also be used for cells with hard shells, particularly for environmental samples. Detergents such as sodium dodecyl sulphate (SDS) and cetyl trimethylammonium bromide (CTAB) may also be implemented to chemical lysis buffers. Cell lysis may also be performed by physical, mechanical, thermal or enzymatic means, in addition to chemically-induced cell lysis mentioned previously. The device may include more complex architecture depending on the type of sample, such as nanoscale barbs, nanowires, sonication capability in a separate chamber of the device, integrated laser, integrated heater, for example, a Peltier-type heater, or a thin-film planar heater, and/or microcapillary probes for electrical lysis. Any samples described herein can be used in this workflow. For example samples may include liquid samples collected from a subject being tested for a condition of interest. FIG. 10 shows an example fluidic, or filtration, device for sample preparation that may be used in Step 1 of the workflow schematic of FIG. 9. The sample preparation fluidic device shown in this figure can process different types of biological sample: finger-prick blood, urine or swabs with fecal, cheek or other collection.

Figure 11:
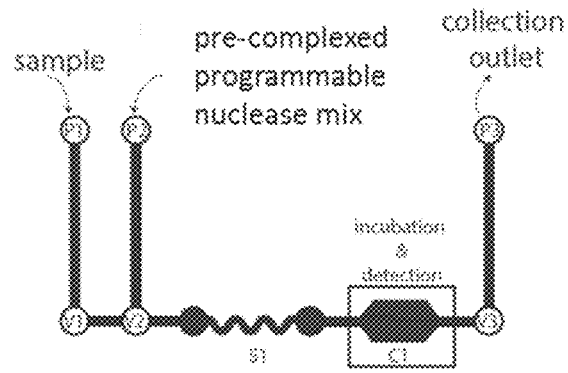
FIG. 11 shows three example fluidic devices for a Cas reaction with a fluorescence or electrochemical readout that may be used in Step 2 to Step 4 of the workflow schematic of FIG. 9. This figure shows that the device performs three iterations of Steps 2 through 4 of the workflow schematic of FIG. 9. An exploded view diagram summarizing the fluorescence and electrochemical processes that may be used for detection of the reaction are shown in FIG. 12.
Figure 11:
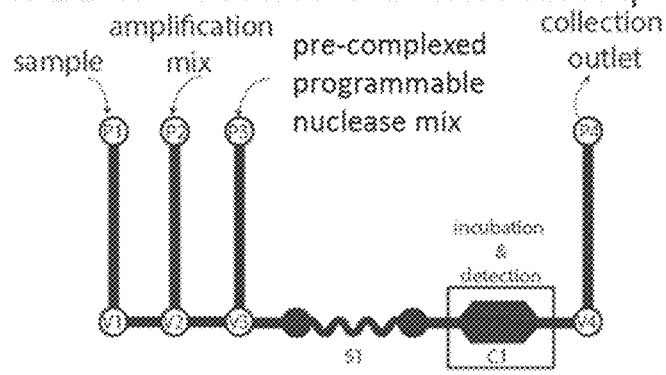
Figure 11:
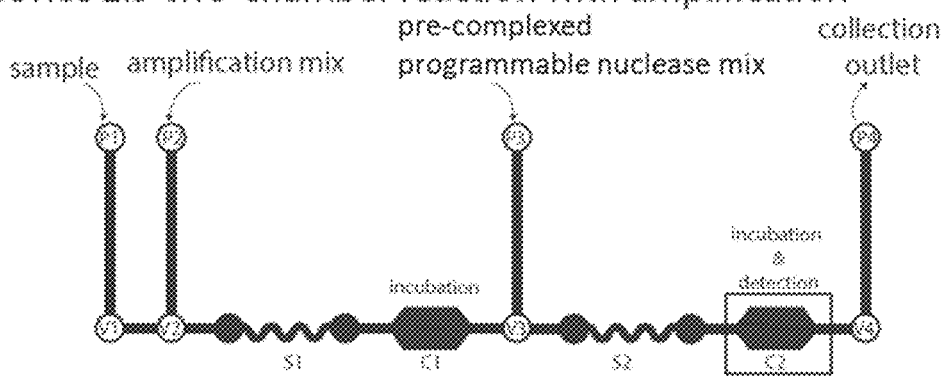
Figure 12:
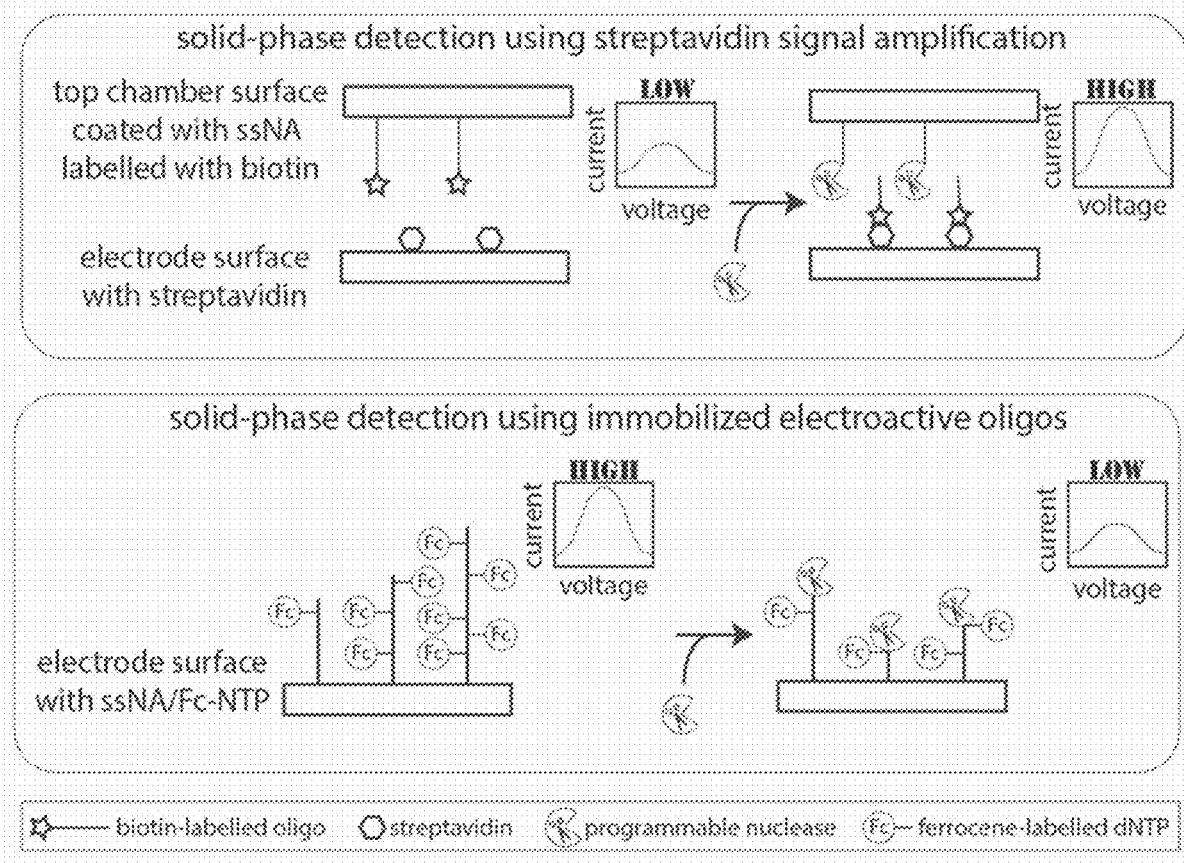
FIG. 12 shows schematic diagrams of a readout process that may be used including (a) fluorescence readout and (b) electrochemical readout.

A fluidic device may be used to carry out any one of, or any combination of, Steps 2-4 of FIG. 9 (nucleic acid amplification, programmable nuclease reaction incubation, detection (readout)). FIG. 11 shows an example fluidic device for a programmable nuclease reaction with a fluorescence or electrochemical readout that may be used in Step 2 to Step 4 of the workflow schematic of FIG. 9. This figure shows that the device performs three iterations of Steps 2 through 4 of the workflow schematic of FIG. 9. At top, is one variation of this fluidic device, which performs the programmable nuclease reaction incubation and detection (readout) steps, but not amplification. Shown in the middle is another variation of said fluidic device, comprising a one-chamber reaction with amplification. Shown at bottom is yet another variation of the fluidic device, comprising a two-chamber reaction with amplification. An exploded view diagram summarizing the fluorescence and electrochemical processes that may be used for detection of the reaction are shown in FIG. 12.

In some embodiments, the fluidic device may be a pneumatic device. The pneumatic device may comprise one or more sample chambers connected to one or more detection chambers by one or more pneumatic valves. Optionally, the pneumatic device may further comprise one or more amplification chamber between the one or more sample chambers and the one or more detection chambers. The one or more amplification chambers may be connected to the one or more sample chambers and the one or more detection chambers by one or more pneumatic valves. A pneumatic valve may be made from PDMS, or any other suitable material. A pneumatic valve may comprise a channel perpendicular to a microfluidic channel connecting the chambers and allowing fluid to pass between chambers when the valve is open. In some embodiments, the channel deflects downward upon application of positive or negative air pressure and through the channel perpendicular to the microfluidic channel.

In some embodiments, the fluidic device may be a sliding valve device. The sliding valve device may comprise a sliding layer with one or more channels and a fixed layer with one or more sample chambers and one or more detection chambers. Optionally, the fixed layer may further comprise one or more amplification chambers. In some embodiments, the sliding layer is the upper layer and the fixed layer is the lower layer. In other embodiments, the sliding layer is the lower layer and the fixed layer is the upper layer. In some embodiments, the upper layer is made of a plastic polymer comprising poly-methacrylate (PMMA), cyclic olefin polymer (COP), cyclic olefin copolymer (COC), polyethylene (PE), high-density polyethylene (HDPE), polypropylene (PP); a glass; or a silicon. In some embodiments, the lower layer is made of a plastic polymer comprising poly-methacrylate (PMMA), cyclic olefin polymer (COP), cyclic olefin copolymer (COC), polyethylene (PE), high-density polyethylene (HDPE), polypropylene (PP); a glass; or a silicon. The sliding valve device may further comprise one or more of a side channel with an opening aligned with an opening in the sample chamber, a side channel with an opening aligned with an opening in the amplification chamber, or a side channel with an opening aligned with the opening in the detection chamber. In some embodiments the side channels are connected to a mixing chamber to allow transfer of fluid between the chambers. In some embodiments, the sliding valve device comprises a pneumatic pump for mixing, aspirating, and dispensing fluid in the device.

The chip (also referred to as fluidic device) may be manufactured from a variety of different materials. Exemplary materials that may be used include plastic polymers, such as poly-methacrylate (PMMA), cyclic olefin polymer (COP), cyclic olefin copolymer (COC), polyethylene (PE), high-density polyethylene (HDPE), polypropylene (PP); glass; and silicon. Features of the chip may be manufactured by various processes. For example, features may be (1) embossed using injection molding, (2) micro-milled or micro-engraved using computer numerical control (CNC) micromachining, or non-contact laser drilling (by means of a CO2 laser source); (3) additive manufacturing, and/or (4) photolithographic methods.

The design may include up to three (3) input ports operated by three (3) pumps, labelled on FIG. 11 as P1-P3. The pumps may be operated by external syringe pumps using low pressure or high pressure. The pumps may be passive, and/or active (pneumatic, piezoelectric, Braille pin, electroosmotic, acoustic, gas permeation, or other).

The ports may be connected to pneumatic pressure pumps, air or gas may be pumped into the microfluidic channels to control the injection of fluids into the fluidic device. At least three reservoirs may be connected to the device, each containing buffered solutions of: (1) sample, which may be a solution containing purified nucleic acids processed in a separate fluidic device, or neat sample (blood, saliva, urine, stool, and/or sputum); (2) amplification mastermix, which varies depending on the method used, wherein the method may include any of loop-mediated isothermal amplification (LAMP), strand displacement amplification (SDA), recombinase polymerase amplification (RPA), helicase dependent amplification (HDA), multiple displacement amplification (MDA), rolling circle amplification (RCA), and nucleic acid sequence-based amplification (NASBA), transcription mediated amplification (TMA), circular helicase dependent amplification (cHDA), exponential amplification reaction (EXPAR), ligase chain reaction (LCR), simple method amplifying RNA targets (SMART), single primer isothermal amplification (SPIA), hinge-initiated primer-dependent amplification of nucleic acids (HIP), nicking enzyme amplification reaction (NEAR), or improved multiple displacement amplification (IMDA); and (3) pre-complexed programmable nuclease mix, which includes one or more programmable nuclease and guide oligonucleotides. The method of nucleic acid amplification may also be polymerase chain reaction (PCR), which includes cycling of the incubation temperature at different levels, hence is not defined as isothermal. Often, the reagents for nucleic acid amplification comprise a recombinase, a oligonucleotide primer, a single-stranded DNA binding (SSB) protein, and a polymerase. Sometimes, nucleic acid amplification of the sample improves at least one of sensitivity, specificity, or accuracy of the assay in detecting the target nucleic acid. In some cases, the nucleic acid amplification is performed in a nucleic acid amplification region on the support medium. Alternatively or in combination, the nucleic acid amplification is performed in a reagent chamber, and the resulting sample is applied to the support medium. Sometimes, the nucleic acid amplification is isothermal nucleic acid amplification. Complex formation of a nuclease with guides (a programmable nuclease) and reporter probes may occur off the chip. An additional port for output of the final reaction products is depicted at the end of the fluidic path, and is operated by a similar pump, as the ones described for P1-P3. The reactions product can be, thus, collected for additional processing and/or characterization, e.g., sequencing.

The flow of liquid in this fluidic device may be controlled using up to four (4) microvalves, labelled in FIG. 11 as V1-V4. These valves can be electro-kinetic microvalves, pneumatic microvalves, vacuum microvalves, capillary microvalves, pinch microvalves, phase-change microvalves, burst microvalves.

The flow to and from the fluidic channel from each of P1-P4 is controlled by valves, labelled as V1-V4. The volume of liquids pumped into the ports can vary from nL to mL depending in the overall size of the device.

In device iteration 2.1, shows in FIG. 11, no amplification is needed. After addition of sample and pre-complexed programmable nuclease mix in P1 and P2, respectively, the reagents may be mixed in the serpentine channel, 51, which then leads to chamber C1 where the mixture may be incubated at the required temperature and time. The readout can be done simultaneously in C1, described in FIG. 12. Thermoregulation in C1 may be carried out using a thin-film planar heater manufactured, from e.g. Kapton, or other similar materials, and controlled by a proportional integral derivative (PID).

In device iteration 2.2, shown in FIG. 11, after addition of sample, amplification mix, and pre-complexed programmable nuclease mix in P1, P2 and P3, respectively, the reagents can be mixed in the serpentine channel, 51, which then leads to chamber C1 where the mixture is incubated at the required temperature and time needed to efficient amplification, as per the conditions of the method used. The readout may be done simultaneously in C1, described in FIG. 12. Thermoregulation may be achieved as previously described.

In device iteration 2.3, shown in FIG. 11, amplification and programmable nuclease reactions occur in separate chambers. The pre-complexed programmable nuclease mix is pumped into the amplified mixture from C1 using pump P3. The liquid flow is controlled by valve V3, and directed into serpentine mixer S2, and subsequently in chamber C2 for incubation the required temperature, for example at 37° C. for 90 minutes.

During the detection step (shown as step 4 in the workflow diagram of FIG. 9), the Cas-gRNA complex binds to its matching nucleic acid target from the amplified sample and is activated into a non-specific nuclease, which cleaves a nucleic acid-based reporter molecule to generate a signal readout. In the absence of a matching nucleic acid target, the Cas-gRNA complex does not cleave the nucleic acid-based reporter molecule. Real-time detection of the Cas reaction can be achieved by three methods: (1) fluorescence, (2) electrochemical detection, and (3) electrochemiluminescence. All three methods are described below and a schematic diagrams of these processes is shown in FIG. 12. Detection of the signal can be achieved by multiple methods, which can detect a signal that is calorimetric, potentiometric, amperometric, optical (e.g., fluorescent, colorometric, etc.), or piezo-electric, as non-limiting examples.

FIG. 12 shows schematic diagrams of a readout process that may be used in conjunction with a fluidic device (e.g., the fluidic device of FIG. 11), including (a) fluorescence readout and (b) electrochemical readout. The emitted fluorescence of cleaved reporter oligo nucleotides may be monitored using a fluorimeter positioned directly above the detection and incubation chamber. The fluorimeter may be a commercially available instrument, the optical sensor of a mobile phone or smart phone, or a custom-made optical array comprising of fluorescence excitation means, e.g. $CO_2$, other, laser and/or light emitting diodes (LEDs), and fluorescence detection means e.g. photodiode array, phototransistor, or others.

The fluorescence detection and excitation may be multiplexed, wherein, for example, fluorescence detection involves exciting and detecting more than one fluorophore in the incubation and detection chamber (C1 or C2). The fluorimeter itself may be multichannel, in which detecting and exciting light at different wavelengths, or more than one fluorimeter may be used in tandem, and their position above the incubation and detection chamber (C1 and C2) be modified by mechanical means, such as a motorized mechanism using micro or macro controllers and actuators (electric, electronic, and/or piezo-electric).

Two electrochemical detection variations are described herein, using integrated working, counter and reference electrodes in the incubation and detection chamber (C1 or C2):

Increase in signal. The progress of the cleavage reaction catalyzed by the programmable nuclease may be detected using a streptavidin-biotin coupled reaction. The top surface of the detection and incubation chamber may be functionalized with nucleic acid molecules (ssRNA, ssDNA or ssRNA/DNA hybrid molecules) conjugated with a biotin moiety. The bottom surface of the detection and incubation chamber operates as an electrode, comprising of working, reference, and counter areas, manufactured (or screen-printed) from carbon, graphene, silver, gold, platinum, boron-doped diamond, copper, bismuth, titanium, antimony, chromium, nickel, tin, aluminum, molybdenum, lead, tantalum, tungsten, steel, carbon steel, cobalt, indium tin oxide (ITO), ruthenium oxide, palladium, silver-coated copper, carbon nano-tubes, or other metals. The bottom surface of the detection and incubation chamber may be coated with streptavidin molecules. In the absence of any biotin molecules, the current measured by a connected electrochemical analyzer (commercial, or custom-made) is low. When the pre-complexed programmable nuclease mix with amplified target flows in the detection and incubation chamber, and is activated at a higher temperature, for example at 37° C., cleavage of the single-stranded nucleic acid (ssNA) linker releases biotin molecules that can diffuse onto the streptavidin-coated bottom surface of the detection and incubation chamber. Because of the interaction of biotin and streptavidin molecules, an increase in the current is read by a coupled electrochemical analyzer.

Other types of signal amplification that use enrichment may also be used apart from biotin-streptavidin excitation. Non-limiting examples are: (1) glutathione, glutathione S-transferase, (2) maltose, maltose-binding protein, (3) chitin, chitin-binding protein.

Decrease in signal. The progress of the programmable nuclease cleavage reaction may be monitored by recording the decrease in the current produced by a ferrocene (Fc) or other electroactive mediator moieties, conjugated to the individual nucleotides of nucleic acid molecules (ssRNA, ssDNA or ssRNA/DNA hybrid molecules) immobilized on the bottom surface of the detection and incubation chamber. In the absence of the amplified target, the programmable nuclease complex remains inactive, and a high current caused by the electroactive moieties is recorded. When the programmable nuclease complex with guides flows in the detection and incubation chamber and is activated by the matching nucleic acid target at 37° C., the programmable nuclease complex non-specifically degrades the immobilized Fc-conjugated nucleic acid molecules. This cleavage reaction decreases the number of electroactive molecules and, thus, leads to a decrease in recorded current.

The electrochemical detection may also be multiplexed. This is achieved by the addition of one or more working electrodes in the incubation and detection chamber (C1 or C2). The electrodes can be plain, or modified, as described above for the single electrochemical detection method.

Electrochemiluminescence in a combined optical and electrochemical readout method. The optical signal may be produced by luminescence of a compound, such as tripropyl amine (TPA) generated as an oxidation product of an electroactive product, such as ruthenium bipyridine, [Ru(py)3]2+.

A number of different programmable nuclease proteins may be multiplexed by: (1) separate fluidic paths (parallelization of channels), mixed with the same sample, for each of the proteins, or (2) switching to digital (two-phase) microfluidics, where each individual droplet contains a separate reaction mix. The droplets could be generated from single or double emulsions of water and oil. The emulsions are compatible with programmable nuclease reaction, and optically inert.

Figure 13:
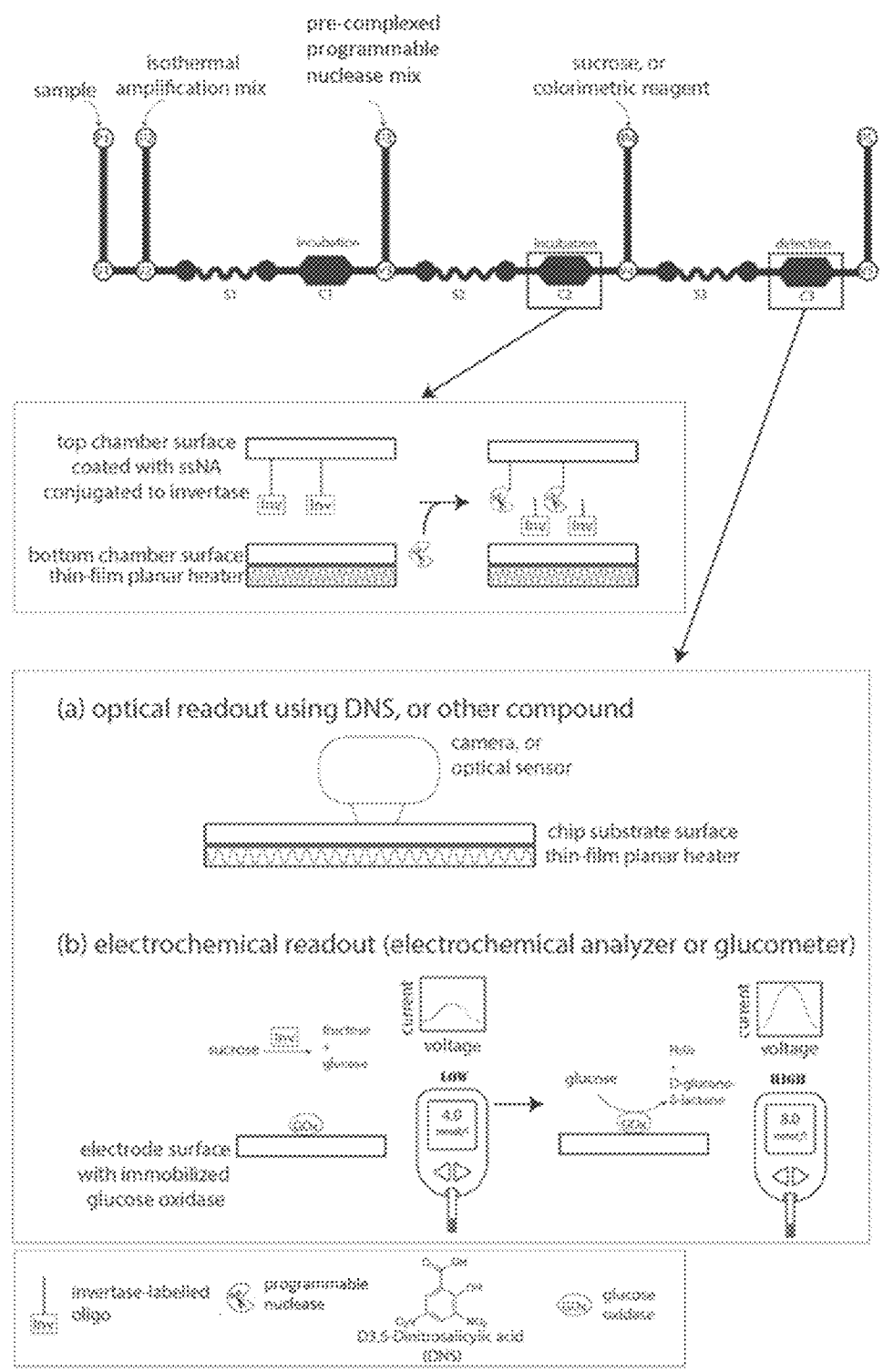
FIG. 13 shows an example fluidic device for coupled invertase/Cas reactions with colorimetric or electrochemical/glucometer readout. This diagram illustrates a fluidic device for miniaturizing a Cas reaction coupled with the enzyme invertase. Surface modification and readout processes are depicted in exploded view schemes at the bottom including (a) optical readout using DNS, or other compound and (b) electrochemical readout (electrochemical analyzer or glucometer).

FIG. 13 shows an example fluidic device for coupled invertase/Cas reactions with colorimetric or electrochemical/glucometer readout. This diagram illustrates a fluidic device for miniaturizing a Cas reaction coupled with the enzyme invertase. Surface modification and readout processes are depicted in exploded view schemes at the bottom including (a) optical readout using DNS, or other compound and (b) electrochemical readout (electrochemical analyzer or glucometer). Described herein is the coupling of the Cas reaction with the enzyme invertase (EC 3.2.1.26), or sucrase or β-fructofuranosidase. This enzyme catalyzes the breakdown of sucrose to fructose and glucose.

The following methods may be used to couple the readout of the Cas reaction to invertase activity:

Colorimetry using a camera, standalone, or an integrated mobile phone optical sensor. The amount of fructose and glucose is linked to a colorimetric reaction. Two examples are: (a) 3,5-Dinitrosalicylic acid (DNS), and (b) formazan dye thiazolyl blue. The color change can be monitored using a CCD camera, or the image sensor of a mobile phone. For this method, we use a variation of the fluidic device described in FIG. 13. The modification is the use of a camera, instead of a fluorimeter above C3.

Amperometry using a conventional glucometer, or an electrochemical analyzer. A variation of the fluidic device described in FIG. 11 may be used, for example, the addition of one more incubation chamber C3. An additional step is added to the reaction scheme, which takes place in chamber C2. The top of the chamber surface is coated with single stranded nucleic acid that is conjugated to the enzyme invertase (Inv). The target-activated programmable nuclease complex cleaves the invertase enzyme from the oligo (ssRNA, ssDNA or ssRNA/DNA hybrid molecule), in C2, and invertase is then available to catalyze the hydrolysis of sucrose injected by pump P4, and controlled by valve V4. The mixture is mixed in serpentine mixer S3, and at chamber C3, the glucose produced may be detected colorimetrically, as previously described, electrochemically. The enzyme glucose oxidase is dried on the surface on C3, and catalyzes the oxidation of glucose to hydrogen peroxide and D-glucono-δ-lactone.

A number of different devices are compatible with detection of target nucleic acids using the methods and compositions disclosed herein. In some embodiments, the device is any of the microfluidic devices disclosed herein. In other embodiments, the device is a lateral flow test strip connected to a reaction chamber. In further embodiments, the lateral flow strip may be connected to a sample preparation device.

In some embodiments, the fluidic device may be a pneumatic device. The pneumatic device may comprise one or more sample chambers connected to one or more detection chambers by one or more pneumatic valves. Optionally, the pneumatic device may further comprise one or more amplification chamber between the one or more sample chambers and the one or more detection chambers. The one or more amplification chambers may be connected to the one or more sample chambers and the one or more detection chambers by one or more pneumatic valves. A pneumatic valve may be made from PDMS, or any other suitable material. A pneumatic valve may comprise a channel perpendicular to a microfluidic channel connecting the chambers and allowing fluid to pass between chambers when the valve is open. In some embodiments, the channel deflects downward upon application of positive or negative air pressure and through the channel perpendicular to the microfluidic channel.

In some embodiments, the fluidic device may be a sliding valve device. The sliding valve device may comprise a sliding layer with one or more channels and a fixed layer with one or more sample chambers and one or more detection chambers. Optionally, the fixed layer may further comprise one or more amplification chambers. In some embodiments, the sliding layer is the upper layer and the fixed layer is the lower layer. In other embodiments, the sliding layer is the lower layer and the fixed layer is the upper layer. In some embodiments, the upper layer is made of a plastic polymer comprising poly-methacrylate (PMMA), cyclic olefin polymer (COP), cyclic olefin copolymer (COC), polyethylene (PE), high-density polyethylene (HDPE), polypropylene (PP); a glass; or a silicon. In some embodiments, the lower layer is made of a plastic polymer comprising poly-methacrylate (PMMA), cyclic olefin polymer (COP), cyclic olefin copolymer (COC), polyethylene (PE), high-density polyethylene (HDPE), polypropylene (PP); a glass; or a silicon. The sliding valve device may further comprise one or more of a side channel with an opening aligned with an opening in the sample chamber, a side channel with an opening aligned with an opening in the amplification chamber, or a side channel with an opening aligned with the opening in the detection chamber. In some embodiments the side channels are connected to a mixing chamber to allow transfer of fluid between the chambers. In some embodiments, the sliding valve device comprises a pneumatic pump for mixing, aspirating, and dispensing fluid in the device.

Pneumatic Valve Device. A microfluidic device particularly well suited for carrying out the DETECTR reactions described herein is one comprising a pneumatic valve, also referred to as a "quake valve". The pneumatic valve can be closed and opened by the flow of air from, for an example, an air manifold. The opening of the pneumatic valve can lead to a downward deflection of the channel comprising the pneumatic valve, which can subsequently deflect downtowards and seal off a microfluidic channel beneath the channel comprising the pneumatic valve. This can lead to stoppage of fluid flow in the microfluidic channel. When the air manifold is turned off, the flow of air through the channel comprising the quake valve ceases and the microfluidic channel beneath the channel comprising the quake valve is "open", and fluid can flow through. In some embodiments, the channel comprising the pneumatic valve may be above or below the microfluidic channel carrying the fluid of interest. In some embodiments, the channel comprising the pneumatic valve can be parallel or perpendicular to the microfluidic channel carrying the fluid of interest. Pneumatic valves can be made of a two hard thermoplastic layers sandwiching a soft silicone layer.

One example layout that is compatible with the compositions and methods disclosed herein is shown in FIG. 100 and FIG. 100. In some embodiments, the device comprises a sample chamber and a detection chamber, wherein the detection chamber is fluidically connected to the sample chamber by a pneumatic valve and wherein the detection chamber comprises any programmable nuclease of the present disclosure. Optionally, the device can also include an amplification chamber that is between the fluidic path from the sample chamber to the detection chamber, is connected to the sample chamber by a pneumatic valve, and is additionally connected to the detection chamber by a pneumatic valve. In some embodiments, the pneumatic valve is made of PDMS, or any other material for forming microfluidic valves. In some embodiments, the sample chamber has a port for inserting a sample. The sample can be inserted using a swab. The sample chamber can have a buffer for lysing the sample. The sample chamber can have a filter between the chamber and the fluidic channel to the amplification or detection chambers. The sample chamber may have an opening for insertion of a sample. A sample can be incubated in the sample chamber for from 30 seconds to 10 minutes. The air manifold may until this point be on, pushing air through the pneumatic valve and keeping the fluidic channel between the sample chamber and the amplification or detection chambers closed. At this stage, the air manifold can be turned off, such that no air is passing through the pneumatic valve, and allowing the microfluidic channel to open up and allow for fluid flow from the sample chamber to the next chamber (e.g., the amplification or detection chambers). In devices where there is an amplification chamber, the lysed sample flows from the sample chamber into the amplification chamber. Otherwise, the lysed sample flows from the sample chamber into the detection chamber. At this stage, the air manifold is turned back on, to push air through the pneumatic valve and seal the microfluidic channel. The amplification chamber holds various reagents for amplification and, optionally, reverse transcription of a target nucleic acid in the sample. These reagents may include forward and reverse primers, a deoxynucleotide triphosphate, a reverse transcriptase, a T7 promoter, a T7 polymerase, or any combination thereof. The sample is allowed to incubate in the amplification chamber for from 5 minutes to 40 minutes. The amplified and, optionally reverse transcribed, sample is moved into the detection chamber as described above: the air manifold is turned off, ceasing air flow through the pneumatic valve and opening the microfluidic channel. The detection chamber can include any programmable nuclease disclosed herein, a guide RNA with a portion reverse complementary to a portion of the target nucleic acid, and any reporter disclosed herein. In some embodiments, the detection chamber may comprise a plurality of guide RNAs. The plurality of guide RNAs may have the same sequence, or one or more of the plurality of guide RNAs may have different sequences. In some embodiments, the plurality of guide RNAs has a portion reverse complementary to a portion of a target nucleic acid different than a second RNA of the plurality of guide RNAs. The plurality of guide RNAs may comprise at least 5, at least 10, at least 15, at least 20, or at least 50 guide RNAs. Once the sample is moved into the detection chamber, the DETECTR reaction can be carried out for 1 minute to 20 minutes. Upon hybridization of the guide RNA to the target nucleic acid, the programmable nuclease is activated and begins to collaterally cleave the reporter, which as described elsewhere in this disclosure has a nucleic acid and one or more molecules that enable detection of cleavage. The detection chamber can interface with a device for reading out for the signal. For example, in the case of a colorimetric or fluorescence signal generated upon cleavage, the detection chamber may be coupled to a spectrophotometer or fluorescence reader. In the case where an electrochemical signal is generated, the detection chamber may have one to 10 metal leads connected to a readout device (e.g., a glucometer), as shown in FIG. 107. FIG. 106 shows a schematic of the top layer of a cartridge of a pneumatic valve device of the present disclosure, highlighting suitable dimensions. The schematic shows one cartridge that is 2 inches by 1.5 inches. FIG. 107 shows a schematic of a modified top layer of a cartridge of a pneumatic valve device of the present disclosure adapted for electrochemical dimension. In this schematic, three lines are shown in the detection chambers (4 chambers at the very right). These three lines represent wiring (or "metal leads"), which is co-molded, 3D-printed, or manually assembled in the disposable cartridge to form a three-electrode system. Electrodes are termed as working, counter, and reference. Electrodes can also be screenprinted on the cartridges. Metals used can be carbon, gold, platinum, or silver. A major advantage of the pneumatic valve device is that the pneumatic valves connecting the various chambers of the device prevent backflow from chamber to chamber, which reduces contamination. Prevention of backflow and preventing sample contamination is especially important for the applications described herein. Sample contamination can result in false positives or can generally confound the limit of detection for a target nucleic acid. As another example, the pneumatic valves disclosed herein are particularly advantageous for devices and methods for multiplex detection. In multiplexed assays, where two or more target nucleic acids are assayed for, it is particularly important that backflow and contamination is avoided. Backflow between chambers in a multiplexed assay can lead to cross-contamination of different guide nucleic acids or different programmably nuclease and can result in false results. Thus, the pneumatic valve device, which is designed to minimize or entirely avoid backflow, is particularly superior, in comparison to other device layouts, for carrying out the detection methods disclosed herein.

FIG. 100 shows a pneumatic valve device layout for a DETECTR assay. FIG. 100A shows a schematic of a pneumatic valve device. A pipette pump aspirates and dispenses samples. An air manifold is connected to a pneumatic pump to open and close the normally closed valve. The pneumatic device moves fluid from one position to the next. The pneumatic valve device design has reduced channel cross talk compared to other device designs. FIG. 100B shows a schematic of a cartridge for use in the pneumatic valve device shown in FIG. 100A. The valve configuration is shown. The normally closed valves (one such valve is indicated by an arrow) comprise an elastomeric seal on top of the channel to isolate each chamber from the rest of the system when the chamber is not in use. The pneumatic pump uses air to open and close the valve as needed to move fluid to the necessary chambers within the cartridge. FIG. 101 shows a valve circuitry layout for the pneumatic valve device shown in FIG. 100A. A sample is placed in the sample well while all valves are closed, as shown at (i.). The sample is lysed in the sample well. The lysed sample is moved from the sample chamber to a second chamber by opening the first quake valve, as shown at (ii.), and aspirating the sample using the pipette pump. The sample is then moved to the first amplification chamber by closing the first quake valve and opening a second quake valve, as shown at (iii.) where it is mixed with the amplification mixture. After the sample is mixed with the amplification mixture, it is moved to a subsequent chamber by closing the second quake valve and opening a third quake valve, as shown at (iv). The sample is moved to the DETECTR chamber by closing the third quake valve and opening a fourth quake valve, as shown at (v). The sample can be moved through a different series of chambers by opening and closing a different series of quake valves, as shown at (vi). Actuation of individual valves in the desired chamber series prevents cross contamination between channels. In some embodiments the sliding valve device has a surface area of 5 cm by 5 cm, 5 by 6 cm, 6 by 7 cm, 7 by 8 cm, 8 by 9 cm, 9 by 10 cm, 10 by 11 cm, 11 by 12 cm, 6 by 9 cm, 7 by 10 cm, 8 by 11 cm, 9 by 12 cm, 10 by 13 cm, 11 by 14 cm, 12 by 11 cm, about 30 sq cm, about 35 sq cm, about 40 sq cm, about 45 sq cm, about 50 sq cm, about 55 sq cm, about 60 sq cm, about 65 sq cm, about 70 sq cm, about 75 sq cm, about 25 sq cm, about 20 sq cm, about 15 sq cm, about 10 sq cm, about 5 sq cm, from 1 to 100 sq cm, from 5 to 10 sq cm, from 10 to 15 sq cm, from 15 to 20 sq cm, from 20 to 25 sq cm, from 25 to 30 sq cm, from 30 to 35 sq cm, from 35 to 40 sq cm, from 40 to 45 sq cm, from 45 to 50 sq cm, from 5 to 90 sq cm, from 10 to 0 sq cm, from 15 to 5 sq cm, from 20 to 10 sq cm, or from 25 to 15 sq cm.

In one embodiment, a pneumatic valve device has the following layout. The device has a first chamber for sample lysis, a second chamber for detection, and a third chamber for amplification. Another way of referring to these chambers is a sample chamber (e.g., the first chamber), a detection chamber (e.g., the second chamber), and an amplification chamber (e.g., the third chamber). In this layout, the present disclosure provides a device for measuring a signal comprising: i) a first chamber comprising a sample and a buffer for lysing the sample; and ii) a second chamber, fluidically connected by a first pneumatic valve to the first chamber, wherein the second chamber comprises a programmable nuclease and a reporter comprising a nucleic acid and a detection moiety, and wherein the second chamber is coupled to a measurement device for measuring the signal from the detection moiety produced by cleavage of the nucleic acid of the reporter. The device further comprises iii) a third chamber fluidically connected by the first pneumatic valve to the first chamber and connected by a second pneumatic valve to the second chamber. In this embodiment, the first pneumatic valve fluidically connecting the first chamber and the second chamber comprises a first channel adjacent to a first microfluidic channel connecting the first chamber and the second chamber. Additionally, the first pneumatic valve fluidically connecting the first chamber and the third chamber comprises a second channel adjacent to a second microfluidic channel connecting the first chamber and the third chamber. The second pneumatic valve fluidically connecting the second chamber and the third chamber comprises a third channel adjacent to a third microfluidic channel connecting the second chamber and the third chamber. Further, the first channel, the second channel, or the third channels are connected to an air manifold. In this embodiment, the second chamber additionally includes a guide nucleic acid. In a variant of this pneumatic device, more than one chamber comprising a programmable nuclease and a reporter are fluidically connected to a single chamber comprising the sample. Further, more than one chamber comprises a programmable nuclease and a reporter are fluidically connected to a single chamber comprising the forward primer, the reverse primer, the dNTP, and the polymerase.

In another embodiment, a pneumatic device has the following layout. The device has a first chamber for sample lysis and a second chamber for detection. Another way of referring to these chambers is a sample chamber (e.g., the first chamber) and a detection chamber (e.g., the second chamber). In this layout, the present disclosure provides a device for measuring a signal comprising: i) a first chamber comprising a sample and a buffer for lysing the sample; and ii) a second chamber, fluidically connected by a first pneumatic valve to the first chamber, wherein the second chamber comprises a programmable nuclease and a reporter comprising a nucleic acid and a detection moiety, and wherein the second chamber is coupled to a measurement device for measuring the signal from the detection moiety produced by cleavage of the nucleic acid of the reporter. In this embodiment, the first pneumatic valve fluidically connecting the first chamber and the second chamber comprises a first channel adjacent to a first microfluidic channel connecting the first chamber and the second chamber. Further, the first channel is connected to an air manifold. In this embodiment, the second chamber additionally includes a guide nucleic acid. In a variant of this pneumatic device, more than one chamber comprising a programmable nuclease and a reporter are fluidically connected to a single chamber comprising the sample.

Sliding Valve Device. A microfluidic device particularly well suited for carrying out the DETECTR reactions described herein is a sliding valve device. The sliding valve device can have a sliding layer and a fixed layer. The sliding layer may be on top and the fixed layer may be on bottom. Alternatively, the sliding layer may be on bottom and the fixed layer may be on top. In some embodiments, the sliding valve has a channel. The channel can have an opening at one end that interacts with an opening in a chamber and the channel can also have an opening at the other end that interacts with an opening in a side channel. In some embodiments, the sliding layer has more than one opening. In some embodiments, the fixed layer comprises a sample chamber, an amplification chamber, and a detection chamber. The sample chamber, the amplification chamber, and the detection layer can all have an opening at the bottom of the chambers. For example, the sample chamber may have an opening for insertion of a sample. When the opening in a chamber is aligned with the opening in a channel, fluid can flow from the chamber into the channel. Further, when the opening in the channel is subsequently aligned with an opening in a side channel, fluid can flow from the channel into the side channel. The side channel can be further fluidically connected to a mixing chamber, or a port in which an instrument (e.g., a pipette pump) for mixing fluid is inserted. Alignment of openings can be enabled by physically moving or automatically actuating the sliding layer to slide along the length of the fixed layer. In some embodiment, the above described pneumatic valves can be added at any position to the sliding valve device in order to control the flow of fluid from one chamber into the next. The sliding valve device can also have multiple layers. For example, the sliding valve can have 2, 3, 4, 5, 6, 7, 8, 9, 10, or more layers.

FIG. 90 shows a layout for a DETECTR assay. Shown at top is a pneumatic pump, which interfaces with the cartridge. Shown at middle is a top down view of the cartridge showing a top layer with reservoirs. Shown at bottom is a sliding valve containing the sample and arrows pointing to the lysis chamber at left, following by amplification chambers to the right, and DETECT chambers further to the right. FIG. 102 shows a schematic of a sliding valve device. The offset pitch of the channels allows aspirating and dispensing into each well separately and helps to mitigate cross talk between the amplification chambers and corresponding chambers. FIG. 103 shows a diagram of sample movement through the sliding valve device shown in FIG. 102. In the initial closed position (i.), the sample is loaded into the sample well and lysed. The sliding valve is then actuated by the instrument, and samples are loaded into each of the channels using the pipette pump, which dispenses the appropriate volume into the channel (ii.). The sample is delivered to the amplification chambers by actuating the sliding valve and mixed with the pipette pump (iii.). Samples from the amplification chamber are aspirated into each channel (iv.) and then dispensed and mixed into each DETECTR chamber (v.) by actuating the sliding valve and pipette pump. In some embodiments the sliding valve device has a surface area of 5 cm by 8 cm, 5 by 6 cm, 6 by 7 cm, 7 by 8 cm, 8 by 9 cm, 9 by 10 cm, 10 by 11 cm, 11 by 12 cm, 6 by 9 cm, 7 by 10 cm, 8 by 11 cm, 9 by 12 cm, 10 by 13 cm, 11 by 14 cm, 12 by 11 cm, about 30 sq cm, about 35 sq cm, about 40 sq cm, about 45 sq cm, about 50 sq cm, about 55 sq cm, about 60 sq cm, about 65 sq cm, about 70 sq cm, about 75 sq cm, about 25 sq cm, about 20 sq cm, about 15 sq cm, about 10 sq cm, about 5 sq cm, from 1 to 100 sq cm, from 5 to 10 sq cm, from 10 to 15 sq cm, from 15 to 20 sq cm, from 20 to 25 sq cm, from 25 to 30 sq cm, from 30 to 35 sq cm, from 35 to 40 sq cm, from 40 to 45 sq cm, from 45 to 50 sq cm, from 5 to 90 sq cm, from 10 to 0 sq cm, from 15 to 5 sq cm, from 20 to 10 sq cm, or from 25 to 15 sq cm.

In one embodiment, a sliding valve device has the following layout. The device has a first chamber for sample lysis, a second chamber for detection, and a third chamber for amplification. Another way of referring to these chambers is a sample chamber (e.g., the first chamber), a detection chamber (e.g., the second chamber), and an amplification chamber (e.g., the third chamber). In this layout, the present disclosure provides a device for measuring a signal comprises: a sliding layer comprising a channel with an opening at a first end of the channel and an opening at a second end of the channel; and a fixed layer comprising: i) a first chamber having an opening; ii) a second chamber having an opening, wherein the second chamber comprises a programmable nuclease and a reporter comprising a nucleic acid and a detection moiety; iii) a first side channel having an opening aligned with the opening of the first chamber; and iv) a second side channel having an opening aligned with the opening of the second chamber, wherein the sliding layer and the fixed layer move relative to each other to fluidically connect the first chamber and the first side channel via the opening at the first end of the channel, the opening at the second end of the channel, the opening of the first chamber, and the opening of the first side channel, and wherein the sliding layer and the fixed layer move relative to each other to fluidically connect the second chamber and the second side channel via the opening at the first end of the channel, the opening at the second end of the channel, the opening of the second chamber, and the opening of the second side channel. The fixed layer further comprises i) a third chamber having an opening; and ii) a third side channel having an opening aligned with the opening of the third chamber, wherein the sliding layer and the fixed layer move relative to each other to fluidically connect the third chamber and the third side channel via the opening at the first end of the channel, the opening at the second end of the channel, the opening of the third chamber, and the opening of the third side channel. The second chamber is coupled to a measurement device for measuring the signal from the detection moiety produced by cleavage of the nucleic acid of the reporter. Additionally, the opening of the first end of the channel overlaps with the opening of the first chamber and the opening of the second end of the channel overlaps with the opening of the first side channel. The opening of the first end of the channel overlaps with the opening of the second chamber and the opening of the second end of the channel overlaps with the opening of the second side channel. The opening of the first end of the channel overlaps with the opening of the third chamber and the opening of the second end of the channel overlaps with the opening of the third channel. Additionally, the first side channel, the second side channel, and the third side channel are fluidically connected to a mixing chamber. In this embodiment, the second chamber additionally includes a guide nucleic acid.

In another embodiment, a sliding valve device has the following layout. The device has a first chamber for sample lysis and a second chamber for detection. Another way of referring to these chambers is a sample chamber (e.g., the first chamber) and a detection chamber. In this layout, the present disclosure provides a device for measuring a signal comprises: a sliding layer comprising a channel with an opening at a first end of the channel and an opening at a second end of the channel; and a fixed layer comprising: i) a first chamber having an opening; ii) a second chamber having an opening, wherein the second chamber comprises a programmable nuclease and a reporter comprising a nucleic acid and a detection moiety; iii) a first side channel having an opening aligned with the opening of the first chamber; and iv) a second side channel having an opening aligned with the opening of the second chamber, wherein the sliding layer and the fixed layer move relative to each other to fluidically connect the first chamber and the first side channel via the opening at the first end of the channel, the opening at the second end of the channel, the opening of the first chamber, and the opening of the first side channel, and wherein the sliding layer and the fixed layer move relative to each other to fluidically connect the second chamber and the second side channel via the opening at the first end of the channel, the opening at the second end of the channel, the opening of the second chamber, and the opening of the second side channel. The second chamber is coupled to a measurement device for measuring the signal from the detection moiety produced by cleavage of the nucleic acid of the reporter. Additionally, the opening of the first end of the channel overlaps with the opening of the first chamber and the opening of the second end of the channel overlaps with the opening of the first side channel. The opening of the first end of the channel overlaps with the opening of the second chamber and the opening of the second end of the channel overlaps with the opening of the second side channel. Additionally, the first side channel and the second side channel are fluidically connected to a mixing chamber. In this embodiment, the second chamber additionally includes a guide nucleic acid.

Figure 73:
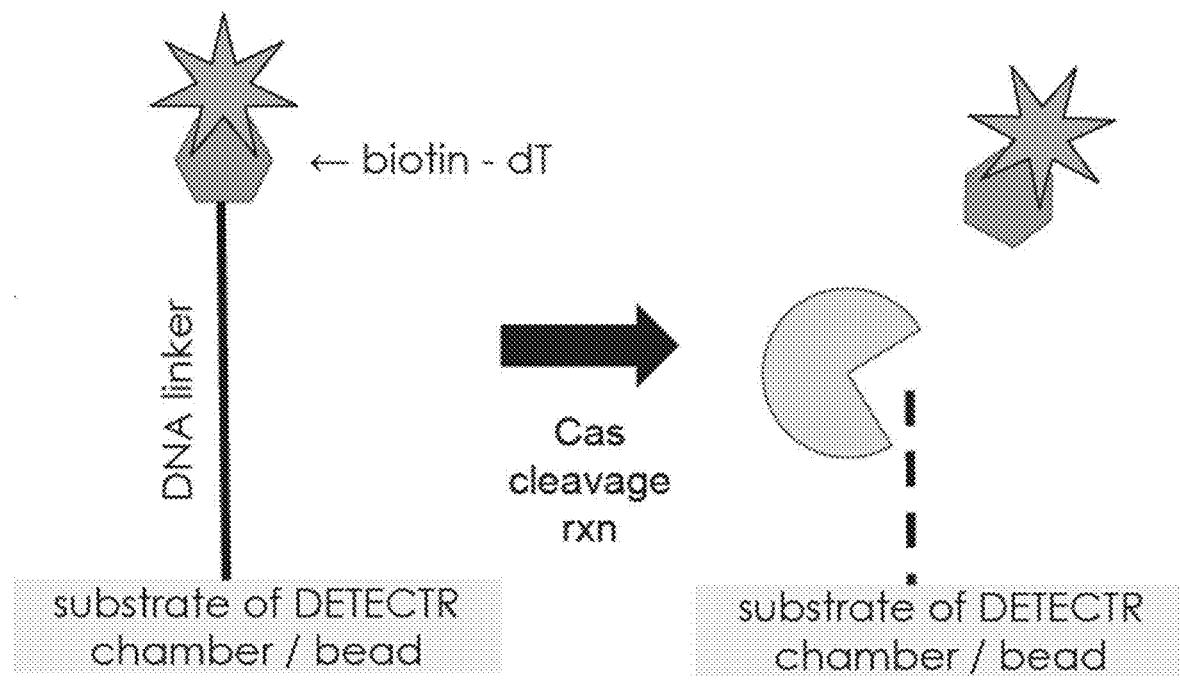
FIG. 73 shows a modified Cas reporter comprising a DNA linker to biotin-dT (shown as a pink hexagon) bound to a FAM molecule (shown as a green start).
Figure 74:
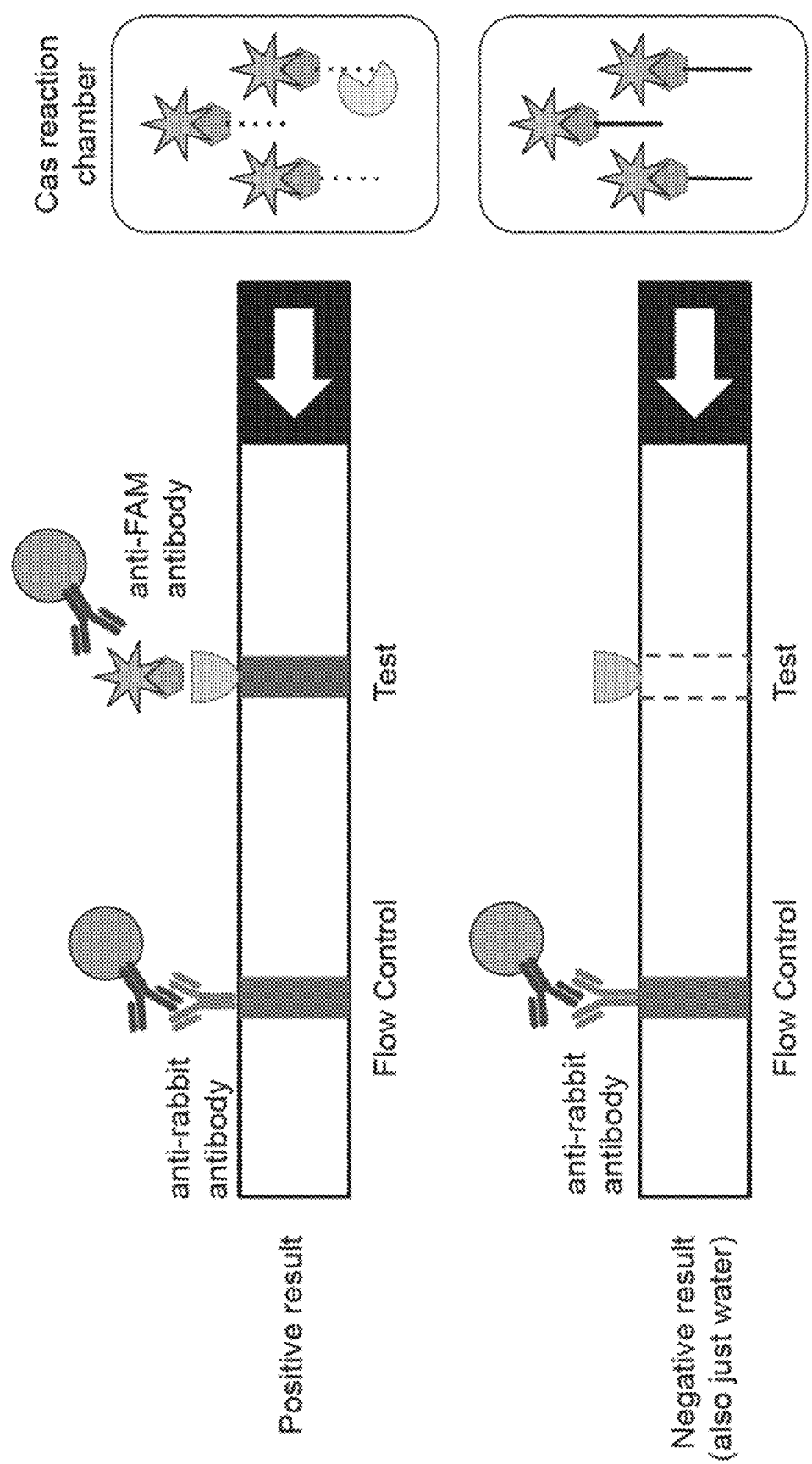

Lateral Flow Devices. In some embodiments, a device of the present disclosure comprises a chamber and a lateral flow strip. FIG. 73-FIG. 74 shows a particularly advantageous layout for the lateral flow strip and a corresponding suitable reporter. FIG. 73 shows a modified Cas reporter comprising a DNA linker to biotin-dT (shown as a pink hexagon) bound to a FAM molecule (shown as a green start). FIG. 74 shows the layout of Milenia HybridDetect strips with the modified Cas reporter. This particular layout improves the test result by generating higher signal in the case of a positive result, while also minimizing false positives. In this assay layout, the reporter comprises a biotin and a fluorophore attached at one of a nucleic acid. The nucleic acid can be directly conjugated to the biotin molecule and the biotin can be directly conjugated to the fluorophore or the nucleic acid can be directly conjugated to the fluorophore and the fluorophore can be directly conjugated to the biotin. In this context, "directly conjugated" indicated that no intervening molecules, polypeptides, proteins, or other moieties are present between the two moieties directly conjugated to each other. For example, if a reporter comprises a nucleic acid directly conjugated to a biotin and a biotin directly conjugated to a fluorophore—no intervening moiety is present between the nucleic acid and the biotin and no intervening moiety is present between the biotin and the fluorophore. Other affinity molecules, including those described herein can be used instead of biotin. Any of the fluorophores disclosed herein can also be used in the reporter. The reporter can be suspended in solution or immobilized on the surface of the Cas chamber. Alternatively, the reporter can be immobilized on beads, such as magnetic beads, in the reaction chamber where they are held in position by a magnet placed below the chamber. When the reporter is cleaved by an activated programmable nuclease, the cleaved biotin-fluorophore accumulates at the first line, which comprises a streptavidin (or another capture molecule such as glutathione-S-transferase, maltose-binding protein, chitin-binding protein). Gold nanoparticles, which are on the sample pad and flown onto the strip using a chase buffer, are coated with an anti-fluorophore antibody allowing binding and accumulation of the gold nanoparticle at the first line. The nanoparticles additionally accumulate at a second line which is coated with an antibody (e.g., anti-rabbit) against the antibody coated on the gold nanoparticles (e.g., rabbit, anti-FAM). In the case of a negative result, the reporter is not cleaved and does not flow on the lateral flow strip. Thus, the nanoparticles only bind and accumulate at the second line Multiplexing on the lateral flow strip can be performed by having two reporters (e.g., a biotin-FAM reporter and a biotin-DIG reporter). Anti-FAM and anti-DIG antibodies are coated onto the lateral flow strip at two different regions. Anti-biotin antibodies are coated on gold nanoparticles. Fluorophores are conjugated directly to the affinity molecules (e.g., biotin) by first generating a biotin-dNTP following from the nucleic acids of the reporter and then conjugating the fluorophore. In some embodiments, the lateral flow strip comprises multiple layers.

Figure 28:
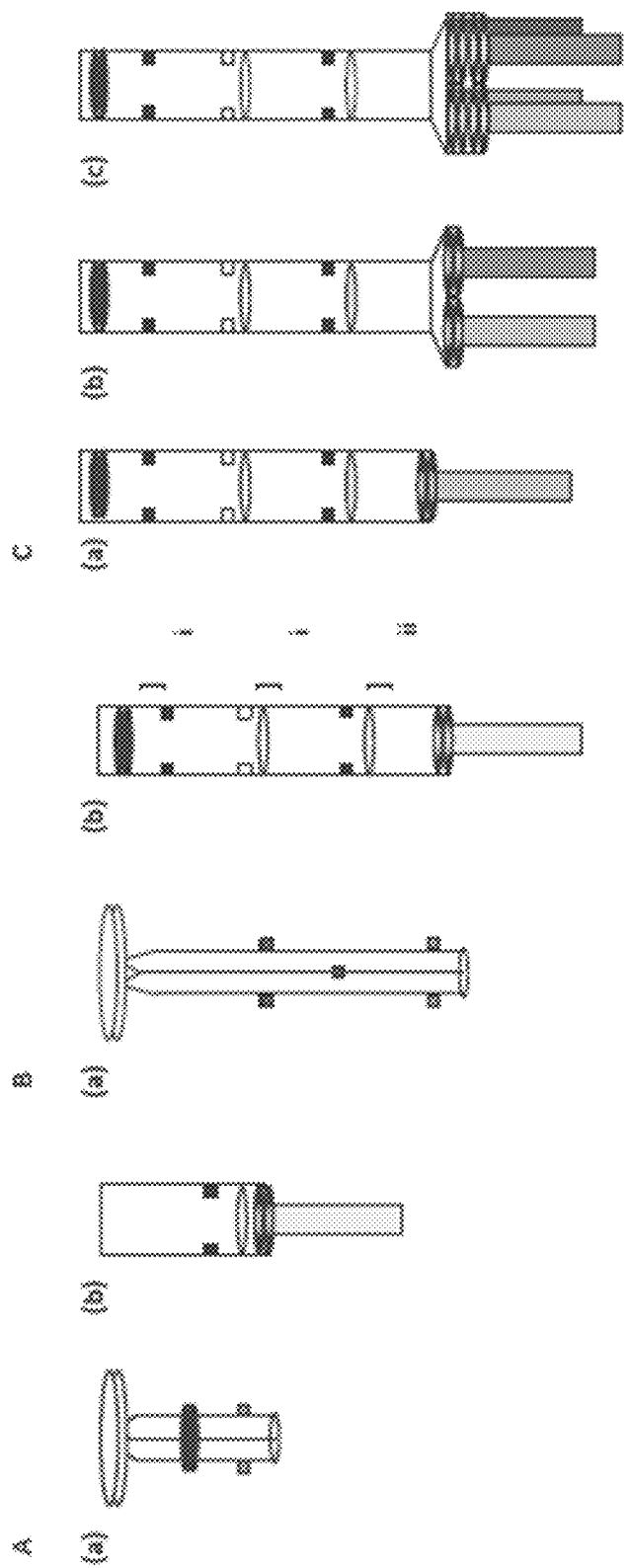
FIG. 28 shows individual parts of sample preparation devices of the present disclosure.
Figure 29:
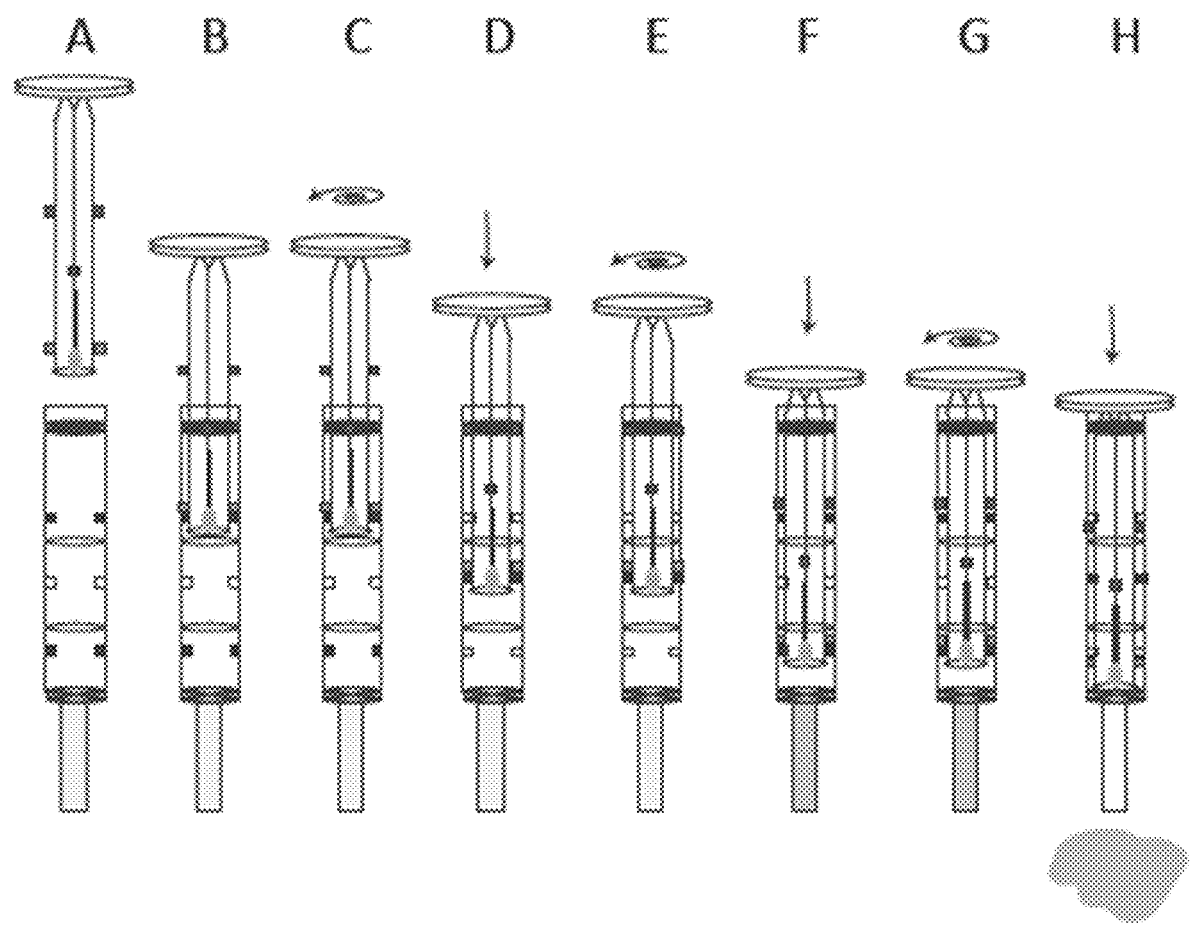
FIG. 29 shows a sample work flow using a sample processing device.

In some embodiments, the above lateral flow strip can be additionally interfaced with a sample preparation device, as shown in FIG. 28 and FIG. 29. FIG. 28 shows individual parts of sample preparation devices of the present disclosure. Part A of the figure shows a single chamber sample extraction device: (a) the insert holds the sample collection device and regulates the step between sample extraction and dispensing the sample into another reaction or detection device, (b) the single chamber contains extraction buffer. Part B of the figure shows filling the dispensing chamber with material that further purifies the nucleic acid as it is dispensed is an option: (a) the insert holds the sample collection device and regulates the "stages" of sample extraction and nucleic acid amplification. Each set of notches (red, blue and green) are offset 90° from the preceding set, (b) the reaction module contains multiple chambers separated by substrates that allow for independent reactions to occur. (e.g., i. a nucleic acid separation chamber, ii. a nucleic acid amplification chamber and iii. a DETECTR reaction chamber or dispensing chamber). Each chamber has notches (black) that prevent the insert from progressing into the next chamber without a deliberate 90° turn. The first two chambers may be separated by material that removes inhibitors between the extraction and amplification reactions. Part C shows options for the reaction/dispensing chamber: (a) a single dispensing chamber may release only extracted sample or extraction/amplification extraction/amplification/DETECTR reactions, (b) a duel dispensing chamber may release extraction/multiplex amplification products, and (c) a quadruple dispensing chamber would allow for multiplexing amplification and single DETECTR or four single amplification reactions. FIG. 29 shows a sample work flow using a sample processing device. The sample collection device is attached to the insert portion of the sample processing device (A). The insert is placed into the device chamber and pressed until the first stop (lower tabs on top portion meet upper tabs on bottom portion) (B). This step allows the sample to come into contact with the nucleic acid extraction reagents. After the appropriate amount of time, the insert is turned 90° (C) and depressed (D) to the next set of notches. These actions transfer the sample into the amplification chamber. The sample collection device is no longer in contact with the sample or amplification products. After the appropriate incubation, the insert is rotated 90° (E) and depressed (F) to the next set of notches. These actions release the sample into the DETECTR (green reaction). The insert is again turned 90° (G) and depressed (H) to dispense the reaction.

General Features of Devices. In some embodiments, a device of the present disclosure can hold 2 or more amplification chambers. In some embodiments, a device of the present disclosure can hold 10 or more detection chambers. In some embodiments, a device of the present disclosure comprises a single chamber in which sample lysis, target nucleic acid amplification, reverse transcription, and detection are all carried out. In some cases, different buffers are present in the different chambers. In some embodiments, all the chambers of a device of the present disclosure have the same buffer. In some embodiments, the sample chamber comprises the lysis buffer and all of the materials in the amplification and detection chambers are lyophilized or vitrified. In some embodiments, the sample chamber includes any buffer for lysing a sample disclosed herein. The amplification chamber can include any buffer disclosed herein compatible with amplification and/or reverse transcription of target nucleic acids. The detection chamber can include any DETECTR or CRISPR buffer (e.g., an MBuffer) disclosed herein or otherwise capable of allowing DETECTR reactions to be carried out. In this case, once sample lysing has occurred, volume is moved from the sample chamber to the other chambers in an amount enough to rehydrate the materials in the other chambers. In some embodiments, the device further comprises a pipette pump at one end for aspirating, mixing, and dispensing liquids. In some embodiments, an automated instrument is used to control aspirating, mixing, and dispensing liquids. In some embodiments, no other instrument is needed for the fluids in the device to move from chamber to chamber or for sample mixing to occur. A device of the present disclosure may be made of any suitable thermoplastic, such as COC, polymer COP, teflon, or another thermoplastic material. Alternatively, the device may be made of glass. In some embodiments, the detection chamber may include beads, such as nanoparticles (e.g., a gold nanoparticle). In some embodiments, the reporters are immobilized on the beads. In some embodiments, after cleavage from the bead, the liberated reporters flow into a secondary detection chamber, where detection of a generated signal occurs by any one of the instruments disclosed herein. In some embodiments, the detection chamber is shallow, but has a large surface area that is optimized for optical detection. A device of the present disclosure may also be coupled to a thermoregulator. For example, the device may be on top of or adjacent to a planar heater that can heat the device up to high temperatures. Alternatively, a metal rod conducting heat is inserted inside the device and presses upon a soft polymer. The heat is transferred to the sample by dissipating through the polymer and into the sample. This allows for sample heating with direct contact between the metal rod and the sample. In some embodiments, in addition to or in place of a buffer for lysing a sample, the sample chamber may include an ultrasonicator for sample lysis. A swab carrying the sample may be inserted directly into the sample chamber. Commonly, a buccal swab may be used, which can carry blood, urine, or a saliva sample. A filter may be included in any of the chambers in the devices disclosed herein to filter the sample prior to carriying it to the next step of the method. Any of the devices disclosed herein can be couple to an additional sample preparation module for further manipulation of the sample before the various steps of the DETECTR reaction. In some embodiments the reporter can be in solution in the detection chamber. In other embodiments, the reporter can be immobilized directly on the surface of the detection chamber. The surface can be the top or the bottom of the chamber. In still other embodiments, the reporter can be immobilized to the surface of a bead. In the case of a bead, after cleavage, the detectable signal may be washed into a subsequent chamber while the bead remains trapped—thus allowing for separation of the detectable signal from the bead. Alternatively, cleavage of the reporter off of the surface of the bead is enough to generate a strong enough detectable signal to be measured. By sequestering or immobilizing the above described reporters, the stability of the reporters in the devices disclosed herein carrying out DETECTR reactions may be improved. Any of the above devices can be compatible for colorimetric, fluorescence, amperometric, potentiometric, or another electrochemical signal. In some embodiments, the colorimetric, fluorescence, amperometric, potentiometric, or another electrochemical sign may be detected using a measurement device connected to the detection chamber (e.g., a fluorescence measurement device, a spectrophotometer, or an oscilloscope).

In some embodiments, signals themself can be amplified, for example via use of an enzyme such as horse radish peroxidase (HRP). In some embodiments, biotin and avidin reactions, which bind at a 4:1 ratio can be used to immobilize multiple enzymes or secondary signal molecules (e.g., 4 enzymes of secondary signal molecules, each on a biotin) to a single protein (e.g., avidin). In some embodiments, an electrochemical signal may be produced by an electrochemical molecule (e.g., biotin, ferrocene, digoxigenin, or invertase). In some embodiments, the above devices could be couple with an additional concentration step. For example, silica membranes may be used to capture nucleic acids off a column and directly apply the Cas reaction mixture on top of said filter. In some embodiments, the sample chamber of any one of the devices disclosed herein can hold from 20 ul to 1000 ul of volume. In some embodiments, the sample chamber holds from 20 to 500, from 40 to 400, from 30 to 300, from 20 to 200 or from 10 to 100 ul of volume. In preferred embodiments, the sample chamber holds 200 ul of volume. The amplification and detection chambers can hold a lower volume than the sample chamber. For example, the amplification and detection chambers may hold from 1 to 50, 10 to 40, 20 to 30, 10 to 40, 5 to 35, 40 to 50, or 1 to 30 ul of volume. Preferrably, the amplification and detection chambers may hold about 200 ul of volume. In some embodiments, an exonuclease is present in the amplification chamber or may be added to the amplification chamber. The exonuclease can clean up single stranded nucleic acids that are not the target. In some embodiments, primers for the target nucleic acid can be phosphorothioated in order to prevent degradation of the target nucleic acid in the presence of the exonuclease. In some embodiments, any of the devices disclosed herein can have a pH balancing well for balancing the pH of a sample. In some embodiments, in each of the above devices, the reporter is present in at least four-fold excess of total nucleic acids (target nucleic acids+non-target nucleic acids). Preferrably the reporter is present in at least 10-fold excess of total nucleic acids. In some embodiments, the reporter is present in at least 4-fold, at least 5-fold at least 6-fold, at least 7-fold, at least 8-fold, at least 9-fold, at least 10-fold, at least 15-fold, at least 20-fold, at least 50-fold, at least 100-fold, from 1.5 to 100-fold, from 4 to 80-fold, from 4 to 10-fold, from 5 to 20-fold or from 4 to 15-fold excess of total nucleic acids. In some embodiments, any of the devices disclosed herein can carry out a DETECTR reaction with a limit of detection of at least 0.1 aM, at least 0.1 nM, at least 1 nM or from 0.1 aM to 1 nM. In some embodiments, the devices disclosed herein can carry out a DETECTR reaction with a positive predictive value of at least 75%, at least 80%, at least 85%, at least 90%, at least 92%, at least 95%, at least 97%, at least 99%, or 100%. In some embodiments, the devices disclosed herein can carry out a DETECTR reaction with a negative predictive value of at least 75%, at least 80%, at least 85%, at least 90%, at least 92%, at least 95%, at least 97%, at least 99%, or 100%. In some embodiments, spatial multiplexing in the above devices is carried out by having at least one, more than one, or every detection chamber in the device comprise a unique guide nucleic acid. A unique guide nucleic acid refers to a sequence of a guide nucleic acid that has an at least one nucleotide difference from the sequences of other guide nucleic acids in a plurality of guide nucleic acids, wherein each unique guide nucleic acid of the plurality bind a different target nucleic acid. Multiple copies of each unique guide nucleic acid may be present. For example, a unique guide nucleic population may comprise multiple copies of the unique guide nucleic acid.

Support Medium

A number of support mediums are consistent with the devices, systems, fluidic devices, kits, and methods disclosed herein. These support mediums are, for example, consistent with fluidic devices disclosed herein for detection of a target nucleic acid within the sample, wherein the fluidic device may comprise multiple pumps, valves, reservoirs, and chambers for sample preparation, amplification of a target nucleic acid within the sample, mixing with a programmable nuclease, and detection of a detectable signal arising from cleavage of detector nucleic acids by the programmable nuclease within the fluidic system itself. These support mediums are compatible with the samples, reagents, and fluidic devices described herein for detection of an ailment, such as a disease, cancer, or genetic disorder, or genetic information, such as for phenotyping, genotyping, or determining ancestry. A support medium described herein can provide a way to present the results from the activity between the reagents and the sample. The support medium provides a medium to present the detectable signal in a detectable format. Optionally, the support medium concentrates the detectable signal to a focused detection area (e.g., a spot, a line, a geometric shape such as a plus sign, or other symbols) in a detection region to increase the sensitivity, specificity, or accuracy of the assay. The support mediums can present the results of the assay and indicate the presence or absence of the disease of interest targeted by the target nucleic acid. The result on the support medium can be read by eye or using a machine. The support medium helps to stabilize the detectable signal generated by the cleaved detector molecule on the surface of the support medium. In some instances, the support medium is a lateral flow assay strip. In some instances, the support medium is a PCR plate. The PCR plate can have 96 wells or 384 wells. The PCR plate can have a subset number of wells of a 96 well plate or a 384 well plate. A subset number of wells of a 96 well PCR plate is, for example, 1, 2, 3, 4, 5, 6, 7, 8, 9, 10, 11, 12, 13, 14, 15, 16, 17, 18, 19, 20, 21, 22, 23, 24, 25, 30, 35, 40, 45, 50, 55, 60, 65, 70, 75, 80, 85, 90, or 95 wells. For example, a PCR subset plate can have 4 wells wherein a well is the size of a well from a 96 well PCR plate (e.g., a 4 well PCR subset plate wherein the wells are the size of a well from a 96 well PCR plate). A subset number of wells of a 384 well PCR plate is, for example, 1, 2, 3, 4, 5, 6, 7, 8, 9, 10, 11, 12, 13, 14, 15, 16, 17, 18, 19, 20, 21, 22, 23, 24, 25, 30, 32, 35, 40, 45, 50, 55, 60, 64, 65, 70, 75, 80, 85, 90, 95, 100, 110, 120, 128, 130, 140, 150, 160, 170, 180, 190, 200, 220, 240, 256, 260, 280, 300, 320, 340, 360, or 380 wells. For example, a PCR subset plate can have 20 wells wherein a well is the size of a well from a 384 well PCR plate (e.g., a 20 well PCR subset plate wherein the wells are the size of a well from a 384 well PCR plate). The PCR plate or PCR subset plate can be paired with a fluorescent light reader, a visible light reader, or other imaging device. Often, the imaging device is a digital camera, such a digital camera on a mobile device. The mobile device may have a software program or a mobile application that can capture an image of the PCR plate or PCR subset plate, identify the assay being performed, detect the individual wells and the sample therein, provide image properties of the individuals wells comprising the assayed sample, analyze the image properties of the contents of the individual wells, and provide a result.

The support medium has at least one specialized zone or region to present the detectable signal. The regions comprise at least one of a sample pad region, a nucleic acid amplification region, a conjugate pad region, a detection region, and a collection pad region. In some instances, the regions are overlapping completely, overlapping partially, or in series and in contact only at the edges of the regions, where the regions are in fluid communication with its adjacent regions. In some instances, the support medium has a sample pad located upstream of the other regions; a conjugate pad region having a means for specifically labeling the detector moiety; a detection region located downstream from sample pad; and at least one matrix which defines a flow path in fluid connection with the sample pad. In some instances, the support medium has an extended base layer on top of which the various zones or regions are placed. The extended base layer may provide a mechanical support for the zones.

Described herein are sample pads that provide an area to apply the sample to the support medium. The sample may be applied to the support medium by a dropper or a pipette on top of the sample pad, by pouring or dispensing the sample on top of the sample pad region, or by dipping the sample pad into a reagent chamber holding the sample. The sample can be applied to the sample pad prior to reaction with the reagents when the reagents are placed on the support medium or be reacted with the reagents prior to application on the sample pad. The sample pad region can transfer the reacted reagents and sample into the other zones of the support medium. Transfer of the reacted reagents and sample may be by capillary action, diffusion, convection or active transport aided by a pump. In some cases, the support medium is integrated with or overlayed by microfluidic channels to facilitate the fluid transport.

The dropper or the pipette may dispense a predetermined volume. In some cases, the predetermined volume may range from about 1 µl to about 1000 µl, about 1 µl to about 500 µl, about 1 µl to about 100 µl, or about 1 µl to about 50 µl. In some cases, the predetermined volume may be at least 1 µl, 2 µl, 3 µl, 4 µl, 5 µl, 6 µl, 7 µl, 8 µl, 9 µl, 10 µl, 25 µl, 50 µl, 75 µl, 100 µl, 250 µl, 500 µl, 750 µl, or 1000 µl. The predetermined volume may be no more than 5 µl, 10 µl, 25 µl, 50 µl, 75 µl, 100 µl, 250 µl, 500 µl, 750 µl, or 1000 µl. The predetermined volume may be from 1 µL to 1000 µL, from 5 µL to 1000 µL, from 10 µL to 1000 µL, from 20 µL to 1000 µL, from 50 µL to 1000 µL, from 100 µL to 1000 µL, from 200 µL to 1000 µL, from 500 µL to 1000 µL, from 750 µL to 1000 µL, from 1 µL to 750 µL, from 5 µL to 750 µL, from 10 µL to 750 µL, from 20 µL to 750 µL, from 50 µL to 750 µL, from 100 µL to 750 µL, from 200 µL to 750 µL, from 500 µL to 750 µL, from 1 µL to 500 µL, from 5 µL to 500 µL, from 10 µL to 500 µL, from 20 µL to 500 µL, from 50 µL to 500 µL, from 100 µL to 500 µL, from 200 µL to 500 µL, from 1 µL to 200 µL, from 5 µL to 200 µL, from 10 µL to 200 µL, from 20 µL to 200 µL, from 50 µL to 200 µL, from 100 µL to 200 µL, from 1 µL to 100 µL, from 5 µL to 100 µL, from 10 µL to 100 µL, from 20 µL to 100 µL, from 50 µL to 100 µL, from 1 µL to 50 µL, from 5 µL to 50 µL, from 10 µL to 50 µL, from 20 µL to 50 µL, from 1 µL to 20 µL, from 5 µL to 20 µL, from 10 µL to 20 µL, from 1 µL to 10 µL, from 5 µL to 10 µL, or from 1 µL to 5 µL. The dropper or the pipette may be disposable or be single-use.

Optionally, a buffer or a fluid may also be applied to the sample pad to help drive the movement of the sample along the support medium. In some cases, the volume of the buffer or the fluid may range from about 1 µl to about 1000 µl, about 1 µl to about 500 µl, about 1 µl to about 100 µl, or about 1 µl to about 50 µl. In some cases, the volume of the buffer or the fluid may be at least 1 µl, 2 µl, 3 µl, 4 µl, 5 µl, 6 µl, 7 µl, 8 µl, 9 µl, 10 µl, 25 µl, 50 µl, 75 µl, 100 µl, 250 µl, 500 µl, 750 µl, or 1000 µl. The volume of the buffer or the fluid may be no more than 5 µl, 10 µl, 25 µl, 50 µl, 75 µl, 100 µl, 250 µl, 500 µl, 750 µl, or 1000 µl. In some cases, the volume of the buffer or the fluid may be from 1 µL to 1000 µL, from 5 µL to 1000 µL, from 10 µL to 1000 µL, from 20 µL to 1000 µL, from 50 µL to 1000 µL, from 100 µL to 1000 µL, from 200 µL to 1000 µL, from 500 µL to 1000 µL, from 750 µL to 1000 µL, from 1 µL to 750 µL, from 5 µL to 750 µL, from 10 µL to 750 µL, from 20 µL to 750 µL, from 50 µL to 750 µL, from 100 µL to 750 µL, from 200 µL to 750 µL, from 500 µL to 750 µL, from 1 µL to 500 µL, from 5 µL to 500 µL, from 10 µL to 500 µL, from 20 µL to 500 µL, from 50 µL to 500 µL, from 100 µL to 500 µL, from 200 µL to 500 µL, from 1 µL to 200 µL, from 5 µL to 200 µL, from 10 µL to 200 µL, from 20 µL to 200 µL, from 50 µL to 200 µL, from 100 µL to 200 µL, from 1 µL to 100 µL, from 5 µL to 100 µL, from 10 µL to 100 µL, from 20 µL to 100 µL, from 50 µL to 100 µL, from 1 µL to 50 µL, from 5 µL to 50 µL, from 10 µL to 50 µL, from 20 µL to 50 µL, from 1 µL to 20 µL, from 5 µL to 20 µL, from 10 µL to 20 µL, from 1 µL to 10 µL, from 5 µL to 10 µL, or from 1 µL to 5 µL. In some cases, the buffer or fluid may have a ratio of the sample to the buffer or fluid of at least 1:1, 1:2, 1:3, 1:4, 1:5, 1:6, 1:7, 1:8, 1:9, or 1:10.

The sample pad can be made from various materials that transfer most of the applied reacted reagents and samples to the subsequent regions. The sample pad may comprise cellulose fiber filters, woven meshes, porous plastic membranes, glass fiber filters, aluminum oxide coated membranes, nitrocellulose, paper, polyester filter, or polymer-based matrices. The material for the sample pad region may be hydrophilic and have low non-specific binding. The material for the sample pad may range from about 50 µm to about 1000 µm, about 50 µm to about 750 µm, about 50 µm to about 500 µm, or about 100 µm to about 500 µm. In some cases the material for the sample pad may range from about 50 µm to about 1000 µm, from about 75 µm to about 1000 µm, from about 100 µm to about 1000 µm, from about 200 µm to about 1000 µm, from about 500 µm to about 1000 µm, from about 750 µm to about 1000 µm, from about 50 µm to about 750 µm, from about 75 µm to about 750 µm, from about 100 µm to about 750 µm, from about 200 µm to about 750 µm, from about 500 µm to about 750 µm, from about 50 µm to about 500 µm, from about 75 µm to about 500 µm, from about 100 µm to about 500 µm, from about 200 µm to about 500 µm, from about 50 µm to about 200 µm, from about 75 µm to about 200 µm, from about 100 µm to about 200 µm, from about 50 µm to about 100 µm, from about 75 µm to about 100 µm, or from about 50 µm to about 75 µm.

The sample pad can be treated with chemicals to improve the presentation of the reaction results on the support medium. The sample pad can be treated to enhance extraction of nucleic acid in the sample, to control the transport of the reacted reagents and sample or the conjugate to other regions of the support medium, or to enhance the binding of the cleaved detection moiety to the conjugate binding molecule on the surface of the conjugate or to the capture molecule in the detection region. The chemicals may comprise detergents, surfactants, buffers, salts, viscosity enhancers, or polypeptides. In some instances, the chemical comprises bovine serum albumin.

Described herein are conjugate pads that provide a region on the support medium comprising conjugates coated on its surface by conjugate binding molecules that can bind to the detector moiety from the cleaved detector molecule or to the control molecule. The conjugate pad can be made from various materials that facilitate binding of the conjugate binding molecule to the detection moiety from cleaved detector molecule and transfer of most of the conjugate-bound detection moiety to the subsequent regions. The conjugate pad may comprise the same material as the sample pad or other zones or a different material than the sample pad. The conjugate pad may comprise glass fiber filters, porous plastic membranes, aluminum oxide coated membranes, paper, cellulose fiber filters, woven meshes, polyester filter, or polymer-based matrices. The material for the conjugate pad region may be hydrophilic, have low non-specific binding, or have consistent fluid flow properties across the conjugate pad. In some cases, the material for the conjugate pad may range from about 50 µm to about 1000 µm, about 50 µm to about 750 µm, about 50 µm to about 500 µm, or about 100 µm to about 500 µm. In some cases, the material for the conjugate pad may range from about 50 μm to about 1000 μm, from about 75 μm to about 1000 μm, from about 100 μm to about 1000 μm, from about 200 μm to about 1000 μm, from about 500 μm to about 1000 μm, from about 750 μm to about 1000 μm, from about 50 μm to about 750 μm, from about 75 μm to about 750 μm, from about 100 μm to about 750 μm, from about 200 μm to about 750 μm, from about 500 μm to about 750 μm, from about 50 μm to about 500 μm, from about 75 μm to about 500 μm, from about 100 μm to about 500 μm, from about 200 μm to about 500 μm, from about 50 μm to about 200 μm, from about 75 μm to about 200 μm, from about 100 μm to about 200 μm, from about 50 μm to about 100 μm, from about 75 μm to about 100 μm, or from about 50 μm to about 75 μm.

Further described herein are conjugates that are placed on the conjugate pad and immobilized to the conjugate pad until the sample is applied to the support medium. The conjugates may comprise a nanoparticle, a gold nanoparticle, a latex nanoparticle, a quantum dot, a chemiluminescent nanoparticle, a carbon nanoparticle, a selenium nanoparticle, a fluorescent nanoparticle, a liposome, or a dendrimer. The surface of the conjugate may be coated by a conjugate binding molecule that binds to the detection moiety from the cleaved detector molecule.

The conjugate binding molecules described herein coat the surface of the conjugates and can bind to detection moiety. The conjugate binding molecule binds selectively to the detection moiety cleaved from the detector nucleic acid. Some suitable conjugate binding molecules comprise an antibody, a polypeptide, or a single stranded nucleic acid. In some cases, the conjugate binding molecule binds a dye and a fluorophore. Some such conjugate binding molecules that bind to a dye or a fluorophore can quench their signal. In some cases, the conjugate binding molecule is a monoclonal antibody. In some cases, an antibody, also referred to as an immunoglobulin, includes any isotype, variable regions, constant regions, Fc region, Fab fragments, F(ab')2 fragments, and Fab' fragments. Alternatively, the conjugate binding molecule is a non-antibody compound that specifically binds the detection moiety. Sometimes, the conjugate binding molecule is a polypeptide that can bind to the detection moiety. Sometimes, the conjugate binding molecule is avidin or a polypeptide that binds biotin. Sometimes, the conjugate binding molecule is a detector moiety binding nucleic acid.

The diameter of the conjugate may be selected to provide a desired surface to volume ratio. In some instances, a high surface area to volume ratio may allow for more conjugate binding molecules that are available to bind to the detection moiety per total volume of the conjugates. In some cases, the diameter of the conjugate may range from about 1 nm to about 1000 nm, about 1 nm to about 500 nm, about 1 nm to about 100 nm, or about 1 nm to about 50 nm. In some cases, the diameter of the conjugate may range from about 2 nm to about 500 nm, from about 5 nm to about 200 nm, from about 10 nm to about 200 nm, or from about 20 nm to about 50 nm. In some cases, the diameter of the conjugate may range from about 1 nm to about 500 nm, from about 10 nm to about 500 nm, from about 100 nm to about 500 nm, from about 200 nm to about 500 nm, from about 300 nm to about 500 nm, from about 1 nm to about 300 nm, from about 10 nm to about 300 nm, from about 100 nm to about 300 nm, from about 200 nm to about 300 nm, from about 1 nm to about 200 nm, from about 10 nm to about 200 nm, from about 100 nm to about 200 nm, from about 1 nm to about 100 nm, from about 10 nm to about 100 nm, or from about 1 nm to about 10 nm. In some cases, the diameter of the conjugate may be at least 1 nm, 2 nm, 3 nm, 4 nm, 5 nm, 6 nm, 7 nm, 8 nm, 9 nm, 10 nm, 15 nm, 20 nm, 25 nm, 30 nm, 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 200 nm, 300 nm, 400 nm, 500 nm, 600 nm, 700 nm, 800 nm, 900 nm, or 1000 nm. In some cases, the diameter of the conjugate may be no more than 1 nm, 2 nm, 3 nm, 4 nm, 5 nm, 6 nm, 7 nm, 8 nm, 9 nm, 10 nm, 15 nm, 20 nm, 25 nm, 30 nm, 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 200 nm, 300 nm, 400 nm, 500 nm, 600 nm, 700 nm, 800 nm, 900 nm, or 1000 nm.

The ratio of conjugate binding molecules to the conjugates can be tailored to achieve desired binding properties between the conjugate binding molecules and the detection moiety. In some instances, the molar ratio of conjugate binding molecules to the conjugates is at least 1:1, 1:5, 1:10, 1:20, 1:30, 1:40, 1:50, 1:60, 1:70, 1:80, 1:90, 1:100, 1:110, 1:120, 1:130, 1:140, 1:150, 1:160, 1:170, 1:180, 1:190, 1:200, 1:250, 1:300, 1:350, 1:400, 1:450, or 1:500. In some instances, the mass ratio of conjugate binding molecules to the conjugates is at least 1:1, 1:5, 1:10, 1:20, 1:30, 1:40, 1:50, 1:60, 1:70, 1:80, 1:90, 1:100, 1:110, 1:120, 1:130, 1:140, 1:150, 1:160, 1:170, 1:180, 1:190, 1:200, 1:250, 1:300, 1:350, 1:400, 1:450, or 1:500. In some instances, the number of conjugate binding molecules per conjugate is at least 1, 10, 50, 100, 500, 1000, 5000, or 10000.

The conjugate binding molecules can be bound to the conjugates by various approaches. Sometimes, the conjugate binding molecule can be bound to the conjugate by passive binding. Some such passive binding comprise adsorption, absorption, hydrophobic interaction, electrostatic interaction, ionic binding, or surface interactions. In some cases, the conjugate binding molecule can be bound to the conjugate covalently. Sometimes, the covalent bonding of the conjugate binding molecule to the conjugate is facilitated by EDC/NHS chemistry or thiol chemistry.

Described herein are detection regions on the support medium that provide a region for presenting the assay results. The detection region can be made from various materials that facilitate binding of the conjugate-bound detection moiety from cleaved detector molecule to the capture molecule specific for the detection moiety. The detection pad may comprise the same material as other zones or a different material than the other zones. The detection region may comprise nitrocellulose, paper, cellulose, cellulose fiber filters, glass fiber filters, porous plastic membranes, aluminum oxide coated membranes, woven meshes, polyester filter, or polymer-based matrices. Often the detection region may comprise nitrocellulose. The material for the region pad region may be hydrophilic, have low non-specific binding, or have consistent fluid flow properties across the region pad. The material for the conjugate pad may range from about 10 μm to about 1000 μm, about 10 μm to about 750 μm, about 10 μm to about 500 μm, or about 10 μm to about 300 μm. In some cases, the material for the conjugate pad may range from about 50 μm to about 1000 μm, from about 75 μm to about 1000 μm, from about 100 μm to about 1000 μm, from about 200 μm to about 1000 μm, from about 500 μm to about 1000 μm, from about 750 μm to about 1000 μm, from about 50 μm to about 750 μm, from about 75 μm to about 750 μm, from about 100 μm to about 750 μm, from about 200 μm to about 750 μm, from about 500 μm to about 750 μm, from about 50 μm to about 500 μm, from about 75 μm to about 500 μm, from about 100 μm to about 500 μm, from about 200 μm to about 500 μm, from about 50 μm to about 200 μm, from about 75 μm to about 200 μm, from about 100 μm to about 200 μm, from about 50

μm to about 100 μm, from about 75 μm to about 100 μm, or from about 50 μm to about 75 μm.

The detection region comprises at least one capture area with a high density of a capture molecule that can bind to the detection moiety from cleaved detection molecule and at least one area with a high density of a positive control capture molecule. The capture area with a high density of capture molecule or a positive control capture molecule may be a line, a circle, an oval, a rectangle, a triangle, a plus sign, or any other shapes. In some instances, the detection region comprise more than one capture area with high densities of more than one capture molecules, where each capture area comprises one type of capture molecule that specifically binds to one type of detection moiety from cleaved detection molecule and are different from the capture molecules in the other capture areas. The capture areas with different capture molecules may be overlapping completely, overlapping partially, or spatially separate from each other. In some instances, the capture areas may overlap and produce a combined detectable signal distinct from the detectable signals generated by the individual capture areas. Usually, the positive control spot is spatially distinct from any of the detection spot.

The capture molecules described herein can bind to a detection moiety and can be immobilized in the detection area in the detect region. Some suitable capture molecules comprise an antibody, a polypeptide, or a single stranded nucleic acid. In some cases, the capture molecule binds a dye and a fluorophore. Some such capture molecules that bind to a dye or a fluorophore can quench their signal. Sometimes, the capture molecule is an antibody that binds to a dye or a fluorophore. In some cases, the capture molecule is a monoclonal antibody. In some cases, an antibody, also referred to as an immunoglobulin, includes any isotype, variable regions, constant regions, Fc region, Fab fragments, F(ab')2 fragments, and Fab' fragments. Alternatively, the capture molecule is a non-antibody compound that specifically binds the detection moiety. Sometimes, the capture molecule is a polypeptide that can bind to the detection moiety. In some instances, the detection moiety from cleaved detection molecule has a conjugate bound to the detection moiety, and the conjugate-detection moiety complex may bind to the capture molecule specific to the detection moiety on the detection region. Sometimes, the capture molecule is a polypeptide that can bind to the detection moiety. Sometimes, the capture molecule is avidin or a polypeptide that binds biotin. Sometimes, the capture molecule is a detector moiety binding nucleic acid.

The detection region described herein comprises at least one area with a high density of a positive control capture molecule. The positive control spot in the detection region provides a validation of the assay and a confirmation of completion of the assay. If the positive control spot is not detectable by the visualization methods described herein, the assay is not valid and should be performed again with a new system or kit. The positive control capture molecule binds at least one of the conjugate, the conjugate binding molecule, or detection moiety and is immobilized in the positive control spot in the detect region. Some suitable positive control capture molecules comprise an antibody, a polypeptide, or a single stranded nucleic acid. In some cases, the positive control capture molecule binds to the conjugate binding molecule. Some such positive control capture molecules that bind to a dye or a fluorophore can quench their signal. Sometimes, the positive control capture molecule is an antibody that binds to a dye or a fluorophore. In some cases, the positive control capture molecule is a monoclonal antibody. In some cases, an antibody includes any isotype, variable regions, constant regions, Fc region, Fab fragments, F(ab')2 fragments, and Fab' fragments. Alternatively, the positive control capture molecule is a non-antibody compound that specifically binds the detection moiety. Sometimes, the positive control capture molecule is a polypeptide that can bind to at least one of the conjugate, the conjugate binding molecule, or detection moiety. In some instances, the conjugate unbound to the detection moiety binds to the positive control capture molecule specific to at least one of the conjugate, the conjugate binding molecule.

Housing

A support medium as described herein can be housed in a number of ways that are consistent with the devices, systems, fluidic devices, kits, and methods disclosed herein. The housing for the support medium are, for example, consistent with fluidic devices disclosed herein for detection of a target nucleic acid within the sample, wherein the fluidic device may comprise multiple pumps, valves, reservoirs, and chambers for sample preparation, amplification of a target nucleic acid within the sample, mixing with a programmable nuclease, and detection of a detectable signal arising from cleavage of detector nucleic acids by the programmable nuclease within the fluidic system itself. For example, the fluidic device may be comprise support mediums to channel the flow of fluid from one chamber to another and wherein the entire fluidic device is encased within the housing described herein. Typically, the support medium described herein is encased in a housing to protect the support medium from contamination and from disassembly. The housing can be made of more than one part and assembled to encase the support medium. In some instances, a single housing can encase more than one support medium. The housing can be made from cardboard, plastics, polymers, or materials that provide mechanical protection for the support medium. Often, the material for the housing is inert or does not react with the support medium or the reagents placed on the support medium. The housing may have an upper part which when in place exposes the sample pad to receive the sample and has an opening or window above the detection region to allow the results of the lateral flow assay to be read. The housing may have guide pins on its inner surface that are placed around and on the support medium to help secure the compartments and the support medium in place within the housing. In some cases, the housing encases the entire support medium. Alternatively, the sample pad of the support medium is not encased and is left exposed to facilitate the receiving of the sample while the rest of the support medium is encased in the housing.

The housing and the support medium encased within the housing may be sized to be small, portable, and hand held. The small size of the housing and the support medium would facilitate the transport and use of the assay in remote regions or low resource settings. In some cases, the housing has a length of no more than 30 cm, 25 cm, 20 cm, 15 cm, 10 cm, or 5 cm. In some cases, the housing has a length of at least 1 cm, 5 cm, 10 cm, 15 cm, 20 cm, 25 cm, or 30 cm. In some cases the housing has a length of from 1 cm to 30 cm, from 5 cm to 30 cm, from 10 cm to 30 cm, from 15 cm to 30 cm, from 20 cm to 30 cm, from 25 cm to 30 cm, from 1 cm to 25 cm, from 5 cm to 25 cm, from 10 cm to 25 cm, from 15 cm to 25 cm, from 20 cm to 25 cm, from 1 cm to 20 cm, from 5 cm to 20 cm, from 10 cm to 20 cm, from 15 cm to 20 cm, from 1 cm to 15 cm, from 5 cm to 15 cm, from 10 cm to 15 cm, from 1 cm to 10 cm, from 5 cm to 10 cm, or from 1 cm to 5 cm. In some cases, the housing has a width of no more than 30 cm, 25 cm, 20 cm, 15 cm, 10 cm, 5 cm, 4 cm, 3 cm, 2 cm, or 1 cm. In some cases, the housing has a width of at least 1 cm, 2 cm, 3 cm, 4 cm, 5 cm, 10 cm, 15 cm, 20 cm, 25 cm, or 30 cm. In some cases the housing has a width of from 1 cm to 30 cm, from 5 cm to 30 cm, from 10 cm to 30 cm, from 15 cm to 30 cm, from 20 cm to 30 cm, from 25 cm to 30 cm, from 1 cm to 25 cm, from 5 cm to 25 cm, from 10 cm to 25 cm, from 15 cm to 25 cm, from 20 cm to 25 cm, from 1 cm to 20 cm, from 5 cm to 20 cm, from 10 cm to 20 cm, from 15 cm to 20 cm, from 1 cm to 15 cm, from 5 cm to 15 cm, from 10 cm to 15 cm, from 1 cm to 10 cm, from 5 cm to 10 cm, or from 1 cm to 5 cm. In some cases, the housing has a height of no more than 10 cm, 9 cm, 8 cm, 7 cm, 6 cm, 5 cm, 4 cm, 3 cm, 2 cm, or 1 cm. In some cases, the housing has a height of at least 1 cm, 2 cm, 3 cm, 4 cm, 5 cm, 6 cm, 7 cm, 8 cm, 9 cm, or 10 cm. In some cases the housing has a height of from 1 cm to 30 cm, from 5 cm to 30 cm, from 10 cm to 30 cm, from 15 cm to 30 cm, from 20 cm to 30 cm, from 25 cm to 30 cm, from 1 cm to 25 cm, from 5 cm to 25 cm, from 10 cm to 25 cm, from 15 cm to 25 cm, from 20 cm to 25 cm, from 1 cm to 20 cm, from 5 cm to 20 cm, from 10 cm to 20 cm, from 15 cm to 20 cm, from 1 cm to 15 cm, from 5 cm to 15 cm, from 10 cm to 15 cm, from 1 cm to 10 cm, from 5 cm to 10 cm, or from 1 cm to 5 cm. Typically, the housing is rectangular in shape.

In some instances, the housing provides additional information on the outer surface of the upper cover to facilitate the identification of the test type, visualization of the detection region, and analysis of the results. The upper outer housing may have identification label including but not limited to barcodes, QR codes, identification label, or other visually identifiable labels. In some instances, the identification label is imaged by a camera on a mobile device, and the image is analyzed to identify the disease, cancer, or genetic disorder that is being tested for. The correct identification of the test is important to accurately visualize and analyze the results. In some instances, the upper outer housing has fiduciary markers to orient the detection region to distinguish the positive control spot from the detection spots. In some instances, the upper outer housing has a color reference guide. When the detection region is imaged with the color reference guide, the detection spots, located using the fiduciary marker, can be compared with the positive control spot and the color reference guide to determine various image properties of the detection spot such as color, color intensity, and size of the spot. In some instances, the color reference guide has red, green, blue, black, and white colors. In some cases, the image of the detection spot can be normalized to at least one of the reference colors of the color reference guide, compared to at least two of the reference colors of the color reference guide, and generate a value for the detection spot. Sometimes, the comparison to at least two of the reference colors is comparison to a standard reference scale. In some instance, the image of the detection spot in some instance undergoes transformation or filtering prior to analysis. Analysis of the image properties of the detection spot can provide information regarding presence or absence of the target nucleic acid targeted by the assay and the disease, cancer, or genetic disorder associated with the target nucleic acid. In some instances, the analysis provides a qualitative result of presence or absence of the target nucleic acid in the sample. In some instances, the analysis provides a semi-quantitative or quantitative result of the level of the target nucleic acid present in the sample. Quantification may be performed by having a set of standards in spots/wells and comparing the test sample to the range of standards. A more semi-quantitative approach may be performed by calculating the color intensity of 2 spots/ well compared to each other and measuring if one spot/well is more intense than the other. Sometimes, quantification is of quantification of circulating nucleic acid. The circulating nucleic acid can comprise a target nucleic acid. For example, a method of circulating nucleic acid quantification comprises assaying for a target nucleic acid of circulating nucleic acid in a first aliquot of a sample, assaying for a control nucleic acid in a second aliquot of the sample, and quantifying the target nucleic acid target in the first aliquot by measuring a signal produced by cleavage of a detector nucleic acid. Sometimes, a method of circulating RNA quantification comprises assaying for a target nucleic acid of the circulating RNA in a first aliquot of a sample, assaying for a control nucleic acid in a second aliquot of the sample, and quantifying the target nucleic acid target in the first aliquot by measuring a signal produced by cleavage of a detector nucleic acid. Often, the output comprises fluorescence/second. The reaction rate, sometimes, is log linear for output signal and target nucleic acid concentration. In some instances, the signal output is correlated with the target nucleic acid concentration. Sometimes, the circulating nucleic acid is DNA.

Detection/Visualization Devices

A number of detection or visualization devices and methods are consistent with the devices, systems, fluidic devices, kits, and methods disclosed herein. Methods of detection/visualization are, for example, consistent with fluidic devices disclosed herein for detection of a target nucleic acid within the sample, wherein the fluidic device may comprise multiple pumps, valves, reservoirs, and chambers for sample preparation, amplification of a target nucleic acid within the sample, mixing with a programmable nuclease, and detection of a detectable signal arising from cleavage of detector nucleic acids by the programmable nuclease within the fluidic system itself. For example, the fluidic device may comprise an incubation and detection chamber or a stand-alone detection chamber, in which a colorimetric, fluorescence, electrochemical, or electrochemiluminescence signal is generated for detection/visualization. Sometimes, the signal generated for detection is a calorimetric, potentiometric, amperometric, optical (e.g., fluorescent, colorometric, etc.), or piezo-electric signal. Often a calorimetric signal is heat produced after cleavage of the detector nucleic acids. Sometimes, a calorimetric signal is heat absorbed after cleavage of the detector nucleic acids. A potentiometric signal, for example, is electrical potential produced after cleavage of the detector nucleic acids. An amperometric signal can be movement of electrons produced after the cleavage of detector nucleic acid. Often, the signal is an optical signal, such as a colorometric signal or a fluorescence signal. An optical signal is, for example, a light output produced after the cleavage of the detector nucleic acids. Sometimes, an optical signal is a change in light absorbance between before and after the cleavage of detector nucleic acids. Often, a piezo-electric signal is a change in mass between before and after the cleavage of the detector nucleic acid. Sometimes, the detector nucleic acid is protein-nucleic acid. Often, the protein-nucleic acid is an enzyme-nucleic acid. The detection/visualization can be analyzed using various methods, as further described below. The results from the detection region from a completed assay can be visualized and analyzed in various ways. In some cases, the positive control spot and the detection spot in the detection region is visible by eye, and the results can be read by the user. In some cases, the positive control spot and the detection spot in the detection region is visualized by an imaging device. Often, the imaging device is a digital camera, such a digital camera on a mobile device. The mobile device may have a software program or a mobile application that can capture an image of the support medium, identify the assay being performed, detect the detection region, provide image properties of the detection spot, analyze the image properties of the detection spot, and provide a result. Alternatively or in combination, the imaging device can capture fluorescence, ultraviolet (UV), infrared (IR), or visible wavelength signals. The imaging device may have an excitation source to provide the excitation energy and captures the emitted signals. In some cases, the excitation source can be a camera flash and optionally a filter. In some cases, the imaging device is used together with an imaging box that is placed over the support medium to create a dark room to improve imaging. The imaging box can be a cardboard box that the imaging device can fit into before imaging. In some instances, the imaging box has optical lenses, mirrors, filters, or other optical elements to aid in generating a more focused excitation signal or to capture a more focused emission signal. Often, the imaging box and the imaging device are small, handheld, and portable to facilitate the transport and use of the assay in remote or low resource settings.

The assay described herein can be visualized and analyzed by a mobile application (app) or a software program. Using the graphic user interface (GUI) of the app or program, an individual can take an image of the support medium, including the detection region, barcode, reference color scale, and fiduciary markers on the housing, using a camera on a mobile device. The program or app reads the barcode or identifiable label for the test type, locate the fiduciary marker to orient the sample, and read the detectable signals, compare against the reference color grid, and determine the presence or absence of the target nucleic acid, which indicates the presence of the gene, virus, or the agent responsible for the disease, cancer, or genetic disorder. The mobile application can present the results of the test to the individual. The mobile application can store the test results in the mobile application. The mobile application can communicate with a remote device and transfer the data of the test results. The test results can be viewable remotely from the remote device by another individual, including a healthcare professional. A remote user can access the results and use the information to recommend action for treatment, intervention, clean up of an environment.

Manufacturing

The support medium may be assembled with a variety of materials and reagents. Reagents may be dispensed or coated on to the surface of the material for the support medium. The material for the support medium may be laminated to a backing card, and the backing card may be singulated or cut into individual test strips. The device may be manufactured by completely manual, batch-style processing; or a completely automated, in-line continuous process; or a hybrid of the two processing approaches. The batch process may start with sheets or rolls of each material for the support medium. Individual zones of the support medium may be processed independently for dispensing and drying, and the final support medium may be assembled with the independently prepared zones and cut. The batch processing scheme may have a lower cost of equipment, and a higher labor cost than more automated in-line processing, which may have higher equipment costs. In some instances, batch processing may be preferred for low volume production due to the reduced capital investment. In some instances, automated in-line processing may be preferred for high volume production due to reduced production time. Both approaches may be scalable to production level.

In some instances, the support mediums are prepared using various instruments, including an XYZ-direction motion system with dispensers, impregnation tanks, drying ovens, a manual or semi-automated laminator, and cutting methods for reducing roll or sheet stock to appropriate lengths and widths for lamination. For dispensing the conjugate binding molecules for the conjugate zone and capture molecules for the detection zones, an XYZ-direction motion system with dispensers may be used. In some embodiments, the dispenser may dispense by a contact method or a non-contact method.

In automated or semi-automated preparation of the support medium, the support medium may be prepared from rolls of membranes for each region that are ordered into the final assembled order and unfurled from the rolls. For example, the membranes can be ordered from sample pad region to collection pad region from left to right with one membrane corresponding to a region on the support medium, all onto an adhesive cardstock. The dispenser places the reagents, conjugates, detection molecules, and other treatments for the membrane onto the membrane. The dispensed fluids are dried onto the membranes by heat, in a low humidity chamber, or by freeze drying to stabilize the dispensed molecules. The membranes are cut into strips and placed into the housing and packaged.

Kits for Assays

A number of kits are consistent with the devices, systems, fluidic devices, kits, and methods disclosed herein for performing the assays as described herein. For example, the kits for assays as disclosed herein can be used to detect a target nucleic acid. These kits are, for example, consistent with fluidic devices disclosed herein for detection of a target nucleic acid within the sample, wherein the fluidic device may comprise multiple pumps, valves, reservoirs, and chambers for sample preparation, amplification of a target nucleic acid within the sample, mixing with a programmable nuclease, and detection of a detectable signal arising from cleavage of detector nucleic acids by the programmable nuclease within the fluidic system itself. In some embodiments, the kit comprises the reagents and the support medium. The reagent may be provided in a reagent chamber or on the support medium. Alternatively, the reagent may be placed into the reagent chamber or the support medium by the individual using the kit. Optionally, the kit further comprises a buffer and a dropper. The reagent chamber be a test well or container. The opening of the reagent chamber may be large enough to accommodate the support medium. The buffer may be provided in a dropper bottle for ease of dispensing. The dropper can be disposable and transfer a fixed volume. The dropper can be used to place a sample into the reagent chamber or on the support medium.

In some embodiments, a kit for detecting a target nucleic acid comprising a support medium; a guide nucleic acid targeting a target nucleic acid segment; a programmable nuclease capable of being activated when complexed with the guide nucleic acid and the target nucleic acid segment; and a single stranded detector nucleic acid comprising a detection moiety, wherein the detector nucleic acid is capable of being cleaved by the activated nuclease, thereby generating a first detectable signal.

In some embodiments, a kit for detecting a target nucleic acid comprising a PCR plate; a guide nucleic acid targeting a target nucleic acid segment; a programmable nuclease capable of being activated when complexed with the guide nucleic acid and the target nucleic acid segment; and a single stranded detector nucleic acid comprising a detection moiety, wherein the detector nucleic acid is capable of being cleaved by the activated nuclease, thereby generating a first detectable signal. The wells of the PCR plate can be pre-aliquoted with the guide nucleic acid targeting a target nucleic acid segment, a programmable nuclease capable of being activated when complexed with the guide nucleic acid and the target sequence, and at least one population of a single stranded detector nucleic acid comprising a detection moiety. A user can thus add the biological sample of interest to a well of the pre-aliquoted PCR plate and measure for the detectable signal with a fluorescent light reader or a visible light reader.

In some instances, such kits may include a package, carrier, or container that is compartmentalized to receive one or more containers such as vials, tubes, and the like, each of the container(s) comprising one of the separate elements to be used in a method described herein. Suitable containers include, for example, test wells, bottles, vials, and test tubes. In one embodiment, the containers are formed from a variety of materials such as glass, plastic, or polymers.

The kit or systems described herein contain packaging materials. Examples of packaging materials include, but are not limited to, pouches, blister packs, bottles, tubes, bags, containers, bottles, and any packaging material suitable for intended mode of use.

A kit typically includes labels listing contents and/or instructions for use, and package inserts with instructions for use. A set of instructions will also typically be included. In one embodiment, a label is on or associated with the container. In some instances, a label is on a container when letters, numbers or other characters forming the label are attached, molded or etched into the container itself; a label is associated with a container when it is present within a receptacle or carrier that also holds the container, e.g., as a package insert. In one embodiment, a label is used to indicate that the contents are to be used for a specific therapeutic application. The label also indicates directions for use of the contents, such as in the methods described herein.

After packaging the formed product and wrapping or boxing to maintain a sterile barrier, the product may be terminally sterilized by heat sterilization, gas sterilization, gamma irradiation, or by electron beam sterilization. Alternatively, the product may be prepared and packaged by aseptic processing.

Reagent Kits

Described herein is a kit comprising the reagents as disclosed herein for detecting a target nucleic acid. These reagent kits are, for example, consistent with fluidic devices disclosed herein for detection of a target nucleic acid within the sample, wherein the fluidic device may comprise multiple pumps, valves, reservoirs, and chambers for sample preparation, amplification of a target nucleic acid within the sample, mixing with a programmable nuclease, and detection of a detectable signal arising from cleavage of detector nucleic acids by the programmable nuclease within the fluidic system itself. The kit may comprise a support medium; a guide nucleic acid targeting a target sequence; a programmable nuclease capable of being activated when complexed with the guide nucleic acid and the target sequence; and a single stranded detector nucleic acid comprising a detection moiety, wherein the detector nucleic acid is capable of being cleaved by the activated nuclease, thereby generating a first detectable signal. The kits described herein may be used for detecting in a biological sample the presence or absence of a target nucleic acid. The kit or system described herein may also comprise a positive control sample to determine that the activity of at least one of programmable nuclease, a guide nucleic acid, or a single stranded detector nucleic acid. Often, the positive control sample comprises a target nucleic acid that binds to the guide nucleic acid. The positive control sample is contacted with the reagents in the same manner as the test sample and visualized using the support medium. The visualization of the positive control spot and the detection spot for the positive control sample provides a validation of the reagents and the assay.

The kit or system for detection of a target nucleic acid described herein further can comprise reagents for protease treatment of the sample. The sample can be treated with protease, such as Proteinase K, before amplification or before assaying for a detectable signal. Often, a protease treatment is for no more than 15 minutes. Sometimes, the protease treatment is for no more than 1, 5, 10, 15, 20, 25, 30, or more minutes, or any value from 1 to 30 minutes. Sometimes, the protease treatment is from 1 minute to 30 minutes, from 5 minutes to 30 minutes, from 10 minutes to 30 minutes, from 15 minutes to 30 minutes, from 20 minutes to 30 minutes, from 25 minutes to 30 minutes, from 1 minute to 25 minutes, from 5 minutes to 25 minutes, from 10 minutes to 25 minutes, from 15 minutes to 25 minutes, from 20 minutes to 25 minutes, from 1 minute to 20 minutes, from 5 minutes to 20 minutes, from 10 minutes to 20 minutes, from 15 minutes to 20 minutes, from 1 minute to 15 minutes, from 5 minutes to 15 minutes, from 10 minutes to 15 minutes, from 1 minute to 10 minutes, from 5 minutes to 10 minutes, or from 1 minute to 5 minutes.

The kit or system for detection of a target nucleic acid described herein further comprises reagents for nucleic acid amplification of target nucleic acids in the sample. Isothermal nucleic acid amplification allows the use of the kit or system in remote regions or low resource settings without specialized equipment for amplification. Often, the reagents for nucleic acid amplification comprise a recombinase, an oligonucleotide primer, a single-stranded DNA binding (SSB) protein, and a polymerase. Sometimes, nucleic acid amplification of the sample improves at least one of sensitivity, specificity, or accuracy of the assay in detecting the target nucleic acid. In some cases, the nucleic acid amplification is performed in a nucleic acid amplification region on the support medium. Alternatively or in combination, the nucleic acid amplification is performed in a reagent chamber, and the resulting sample is applied to the support medium. Sometimes, the nucleic acid amplification is isothermal nucleic acid amplification. In some cases, the nucleic acid amplification is transcription mediated amplification (TMA). Nucleic acid amplification is helicase dependent amplification (HDA) or circular helicase dependent amplification (cHDA) in other cases. In additional cases, nucleic acid amplification is strand displacement amplification (SDA). In some cases, nucleic acid amplification is by recombinase polymerase amplification (RPA). In some cases, nucleic acid amplification is by at least one of loop mediated amplification (LAMP) or the exponential amplification reaction (EXPAR). Nucleic acid amplification is, in some cases, by rolling circle amplification (RCA), ligase chain reaction (LCR), simple method amplifying RNA targets (SMART), single primer isothermal amplification (SPIA), multiple displacement amplification (MDA), nucleic acid sequence based amplification (NASBA), hinge-initiated primer-dependent amplification of nucleic acids (HIP), nicking enzyme amplification reaction (NEAR), or improved multiple displacement amplification (IMDA). In some cases, LAMP amplification can allow for a single amplification step for Cas12 and Cas13 simultaneously. In some embodiments, LAMP can allow for amplification of target nucleic acids for up to three or more than three programmable nucleases simultaneously. In some embodiments, with RPA, fewer primers are needed and multiplexing can be increased to three or six programmable nucleases. Often, the nucleic acid amplification is performed for no greater than 1, 2, 3, 4, 5, 6, 7, 8, 9, 10, 11, 12, 13, 14, 15, 16, 17, 18, 19, 20, 25, 30, 40, 50, or 60 minutes, or any value from 1 to 60 minutes. Sometimes, the nucleic acid amplification is performed for from 1 to 60, from 5 to 55, from 10 to 50, from 15 to 45, from 20 to 40, or from 25 to 35 minutes. Sometimes, the nucleic acid amplification is performed for from 15 minutes to 60 minutes, from 30 minutes to 60 minutes, from 45 minutes to 60 minutes, from 1 minute to 45 minutes, from 15 minutes to 45 minutes, from 30 minutes to 45 minutes, from 1 minute to 30 minutes, from 15 minutes to 30 minutes, from 1 minute to 15 minutes. Sometimes, the nucleic acid amplification reaction is performed at a temperature of around 20-45° C. In some cases, the nucleic acid amplification reaction is performed at a temperature no greater than 20° C., 25° C., 30° C., 35° C., 37° C., 40° C., 45° C., or any value from 20° C. to 45° C. In some cases, the nucleic acid amplification reaction is performed at a temperature of at least 20° C., 25° C., 30° C., 35° C., 37° C., 40° C., or 45° C., or any value from 20° C. to 45° C. In some cases, the nucleic acid amplification reaction is performed at a temperature of from 20° C. to 45° C., from 25° C. to 40° C., from 30° C. to 40° C., or from 35° C. to 40° C. In some cases, the nucleic acid amplification reaction is performed at a temperature of from 20° C. to 45° C., from 25° C. to 45° C., from 30° C. to 45° C., from 35° C. to 45° C., from 40° C. to 45° C., from 20° C. to 37° C., from 25° C. to 37° C., from 30° C. to 37° C., from 35° C. to 37° C., from 20° C. to 30° C., from 25° C. to 30° C., from 20° C. to 25° C., or from 22° C. to 25° C.

Kits, methods, or compositions described herein may comprise reagents for reverse transcription, amplification, in vitro transcription, or any combination thereof. In some embodiments, reagents for amplification can comprise a DNA sequence, dNTPs, a forward primer, a reverse primer, and a polymerase. In some embodiments, reagents for RT-RPA amplification may comprise a DNA or RNA, RPA primers, deoxynucleotide triphosphates (dNTPs), a polymerase, and a reverse transcriptase enzyme. In some embodiments, reagents for an in vitro transcription (IVT) reaction may comprise a DNA, NTPs, and an RNA polymerase enzyme (e.g, T7 RNA polymerase). In some embodiments, reagents for an RT-RPA-IVT combined amplification and transcription reaction may comprise a DNA or RNA sequence, RPA primers, an RPA primer having a T7 promoter, a reverse transcriptase enzyme, dNTPs, NTPs, a recombinase, an RNA polymerase enzyme (e.g, T7 RNA polymerase), or any combination thereof. In some embodiments, reagents for LAMP amplification may comprise a DNA, a plurality of primers (e.g., four, five, or six primers), dNTPs, and a polymerase. In some embodiments, reagents for RT-LAMP amplification may comprise an RNA, a plurality of primers (e.g., four, five, or six primers), dNTPs, a polymerase, and a reverse transcriptase enzyme. In some embodiments, reagents for RT-LAMP-IVT may comprise an RNA, a plurality of primers (e.g., four, five, or six primers), a primer having a T7 promoter, dNTPs, NTPs, a polymerase enzyme, a reverse transcriptase enzyme, and an RNA polymerase (e.g., T7 RNA polymerase). In some embodiments, reagents for SIBA amplification may comprise a DNA having a protospacer adjacent motif (PAM), dNTPs, and a polymerase enzyme. In some embodiments, reagents for RT-SIBA amplification may comprise an RNA having a protospacer adjacent motif (PAM), primers, dNTPs, a polymerase enzyme, and a reverse transcriptase enzyme. The present disclosure provides devices and methods that allow for rapid reverse transcription, amplification, and/or in vitro transcription of target nucleic acids of interest, in one step. Thus, the general reagents for reverse transcription, amplification, and/or in vitro transcription can be combined regardless of the specific method of amplification used.

Sometimes, the total time for the performing the method described herein is no greater than 3 hours, 2 hours, 1 hour, 50 minutes, 40 minutes, 30 minutes, 20 minutes, or any value from 3 hours to 20 minutes. Often, a method of nucleic acid detection from a raw sample comprises protease treating the sample for no more than 15 minutes, amplifying (can also be referred to as pre-amplifying) the sample for no more than 15 minutes, subjecting the sample to a programmable nuclease-mediated detection, and assaying nuclease mediated detection. The total time for performing this method, sometimes, is no greater than 3 hours, 2 hours, 1 hour, 50 minutes, 40 minutes, 30 minutes, 20 minutes, or any value from 3 hours to 20 minutes. The total time for performing this method, sometimes, is from 20 minutes to 3 hours, from 30 minutes to 3 hours, from 45 minutes to 3 hours, from 1 hour to 3 hours, from 1.5 hours to 3 hours, from 2 hours to 3 hours, from 2.5 hours to 3 hours, from 20 minutes to 2.5 hours, from 30 minutes to 2.5 hours, from 45 minutes to 2.5 hours, from 1 hour to 2.5 hours, from 1.5 hours to 2.5 hours, from 2 hours to 2.5 hours, from 20 minutes to 2 hours, from 30 minutes to 2 hours, from 45 minutes to 2 hours, from 1 hour to 2 hours, from 1.5 hours to 2 hours, from 20 minutes to 1.5 hours, from 30 minutes to 1.5 hours, from 45 minutes to 1.5 hours, from 1 hour to 1.5 hours, from 20 minutes to 1 hour, from 30 minutes to 1 hour, from 45 minutes to 1 hour, from 20 minutes to 45 minutes, from 30 minutes to 45 minutes, or from 20 minutes to 30 minutes. Often, the protease treatment is Proteinase K. Often the amplifying is thermal cycling amplification. Sometimes the amplifying is isothermal amplification.

Described herein are collection pad region that provide a region to collect the sample that flows down the support medium. Often the collection pads are placed downstream of the detection region and comprise an absorbent material. The collection pad can increase the total volume of sample that enters the support medium by collecting and removing the sample from other regions of the support medium. This increased volume can be used to wash unbound conjugates away from the detection region to lower the background and enhance assay sensitivity. When the design of the support medium does not include a collection pad, the volume of sample analyzed in the support medium may be determined by the bed volume of the support medium. The collection pad may provide a reservoir for sample volume and may help to provide capillary force for the flow of the sample down the support medium.

The collection pad may be prepared from various materials that are highly absorbent and able to retain fluids. Often the collection pads comprise cellulose filters. In some instances, the collection pads comprise cellulose, cotton, woven meshes, polymer-based matrices. The dimension of the collection pad, usually the length of the collection pad, may be adjusted to change the overall volume absorbed by the support medium.

The support medium described herein may have a barrier around the edge of the support medium. Often the barrier is a hydrophobic barrier that facilitates the maintenance of the sample within the support medium or flow of the sample within the support medium. Usually, the transport rate of the sample in the hydrophobic barrier is much lower than through the regions of the support medium. In some cases, the hydrophobic barrier is prepared by contacting a hydrophobic material around the edge of the support medium. Sometimes, the hydrophobic barrier comprises at least one of wax, polydimethylsiloxane, rubber, or silicone.

Any of the regions on the support medium can be treated with chemicals to improve the visualization of the detection spot and positive control spot on the support medium. The regions can be treated to enhance extraction of nucleic acid in the sample, to control the transport of the reacted reagents and sample or the conjugate to other regions of the support medium, or to enhance the binding of the cleaved detection moiety to the conjugate binding molecule on the surface of the conjugate or to the capture molecule in the detection region. The chemicals may comprise detergents, surfactants, buffers, salts, viscosity enhancers, or polypeptides. In some instances, the chemical comprises bovine serum albumin. In some cases, the chemicals or physical agents enhance flow of the sample with a more even flow across the width of the region. In some cases, the chemicals or physical agents provide a more even mixing of the sample across the width of the region. In some cases, the chemicals or physical agents control flow rate to be faster or slower in order to improve performance of the assay. Sometimes, the performance of the assay is measured by at least one of shorter assay time, longer times during cleavage activity, longer or shorter binding time with the conjugate, sensitivity, specificity, or accuracy.

Packaging Stability

Disclosed herein are stable compositions of the reagents and the programmable nuclease system for use in the methods as discussed above. These stable compositions of the reagents and the programmable nuclease are, for example, consistent with fluidic devices disclosed herein for detection of a target nucleic acid within the sample, wherein the fluidic device may comprise multiple pumps, valves, reservoirs, and chambers for sample preparation, amplification of a target nucleic acid within the sample, mixing with a programmable nuclease, and detection of a detectable signal arising from cleavage of detector nucleic acids by the programmable nuclease. The reagents and programmable nuclease system described herein may be stable in various storage conditions including refrigerated, ambient, and accelerated conditions. Disclosed herein are stable reagents. The stability may be measured for the reagents and programmable nuclease system themselves or the reagents and programmable nuclease system present on the support medium.

In some instances, stable as used herein refers to a reagents having about 5% w/w or less total impurities at the end of a given storage period. Stability may be assessed by HPLC or any other known testing method. The stable reagents may have about 10% w/w, about 5% w/w, about 4% w/w, about 3% w/w, about 2% w/w, about 1% w/w, or about 0.5% w/w total impurities at the end of a given storage period. The stable reagents may have from from 0.5% w/w to 10% w/w, from 1% w/w to 10% w/w, from 2% w/w to 10% w/w, from 3% w/w to 10% w/w, from 5% w/w to 10% w/w, from 7% w/w to 10% w/w, from 8% w/w to 10% w/w, from 0.5% w/w to 8% w/w, from 1% w/w to 8% w/w, from 2% w/w to 8% w/w, from 3% w/w to 8% w/w, from 5% w/w to 8% w/w, from 7% w/w to 8% w/w, from 0.5% w/w to 7% w/w, from 1% w/w to 7% w/w, from 2% w/w to 7% w/w, from 3% w/w to 7% w/w, from 5% w/w to 7% w/w, from 0.5% w/w to 5% w/w, from 1% w/w to 5% w/w, from 2% w/w to 5% w/w, from 3% w/w to 5% w/w, from 0.5% w/w to 3% w/w, from 1% w/w to 3% w/w, from 2% w/w to 3% w/w, from 0.5% w/w to 2% w/w, from 1% w/w to 2% w/w, or from 0.5% w/w to 1% w/w total impurities at the end of a given storage period.

In some embodiments, stable as used herein refers to a reagents and programmable nuclease system having about 10% or less loss of detection activity at the end of a given storage period and at a given storage condition. Detection activity can be assessed by known positive sample using a known method. Alternatively or combination, detection activity can be assessed by the sensitivity, accuracy, or specificity. In some embodiments, the stable reagents has about 10%, about 9%, about 8%, about 7%, about 6%, about 5%, about 4%, about 3%, about 2%, about 1%, or about 0.5% loss of detection activity at the end of a given storage period. In some embodiments, the stable reagents have from 0.5% to 10%, from 1% to 10%, from 2% to 10%, from 3% to 10%, from 5% to 10%, from 7% to 10%, from 8% to 10%, from 0.5% to 8%, from 1% to 8%, from 2% to 8%, from 3% to 8%, from 5% to 8%, from 7% to 8%, from 0.5% to 7%, from 1% to 7%, from 2% to 7%, from 3% to 7%, from 5% to 7%, from 0.5% to 5%, from 1% to 5%, from 2% to 5%, from 3% to 5%, from 0.5% to 3%, from 1% to 3%, from 2% to 3%, from 0.5% to 2%, from 1% to 2%, or from 0.5% to 1% loss of detection activity at the end of a given storage period.

In some embodiments, the stable composition has zero loss of detection activity at the end of a given storage period and at a given storage condition. The given storage condition may comprise humidity of equal to or less than 10%, 20%, 30%, 40%, 50%, 60%, 70%, 80%, 90%, or 100% relative humidity. The controlled storage environment may comprise humidity from 0% to 50% relative humidity, from 0% to 40% relative humidity, from 0% to 30% relative humidity, from 0% to 20% relative humidity, or from 0% to 10% relative humidity. The controlled storage environment may comprise humidity from 0% to 100%, from 10% to 100%, from 20% to 100%, from 30% to 100%, from 50% to 100%, from 70% to 100%, from 80% to 100%, from 90% to 100%, from 0% to 90%, from 10% to 90%, from 20% to 90%, from 30% to 90%, from 50% to 90%, from 70% to 90%, from 80% to 90%, from 0% to 80%, from 10% to 80%, from 20% to 80%, from 30% to 80%, from 50% to 80%, from 70% to 80%, from 0% to 70%, from 10% to 70%, from 20% to 70%, from 30% to 70%, from 50% to 70%, from 0% to 50%, from 10% to 50%, from 20% to 50%, from 30% to 50%, from 0% to 30%, from 10% to 30%, from 20% to 30%, from 0% to 20%, from 10% to 20%, from 0% to 10%, or from 20% to 40%, relative humidity. The controlled storage environment may comprise temperatures of about −100° C., about −80° C., about −20° C., about 4° C., about 25° C. (room temperature), or about 40° C. The controlled storage environment may comprise temperatures from −80° C. to 25° C., or from −100° C. to 40° C. The controlled storage environment may comprise temperatures from −20° C. to 40° C., from −20° C. to 4° C., or from 4° C. to 40° C. The controlled storage environment may protect the system or kit from light or from mechanical damage. The controlled storage environment may be sterile or aseptic or maintain the sterility of the light conduit. The controlled storage environment may be aseptic or sterile.

The kit or system can be packaged to be stored for extended periods of time prior to use. The kit or system may be packaged to avoid degradation of the kit or system. The packaging may include desiccants or other agents to control the humidity within the packaging. The packaging may protect the kit or system from mechanical damage or thermal damage. The packaging may protect the kit or system from contamination of the reagents and programmable nuclease system. The kit or system may be transported under conditions similar to the storage conditions that result in high stability of the reagent or little loss of reagent activity. The packaging may be configured to provide and maintain sterility of the kit or system. The kit or system can be compatible with standard manufacturing and shipping operations.

Definitions

Unless otherwise defined, all technical terms used herein have the same meaning as commonly understood by one of ordinary skill in the art to which this invention belongs. As used in this specification and the appended claims, the singular forms "a," "an," and "the" include plural references unless the context clearly dictates otherwise. Any reference to "or" herein is intended to encompass "and/or" unless otherwise stated.

As used herein, the term "comprising" and its grammatical equivalents specifies the presence of stated features, integers, steps, operations, elements, and/or components, but do not preclude the presence or addition of one or more other features, integers, steps, operations, elements, components, and/or groups thereof. As used herein, the term "and/or" includes any and all combinations of one or more of the associated listed items.

Unless specifically stated or obvious from context, as used herein, the term "about" in reference to a number or range of numbers is understood to mean the stated number and numbers +/−10% thereof, or 10% below the lower listed limit and 10% above the higher listed limit for the values listed for a range.

As used herein the terms "individual," "subject," and "patient" are used interchangeably and include any member of the animal kingdom, including humans.

As used herein the term "antibody" refers to, but not limited to, a monoclonal antibody, a synthetic antibody, a polyclonal antibody, a multispecific antibody (including a bi-specific antibody), a human antibody, a humanized antibody, a chimeric antibody, a single-chain Fv (scFv) (including bi-specific scFvs), a single chain antibody, a Fab fragment, a F(ab') fragment, a F(ab')2 fragment, a disulfide-linked Fvs (sdFv), or an epitope-binding fragment thereof. In some cases, the antibody is an immunoglobulin molecule Or an immunologically active portion of an immunoglobulin molecule. In some instances, an antibody is animal in origin including birds and mammals. Alternately, an antibody is human or a humanized monoclonal antibody.

Figure 1:
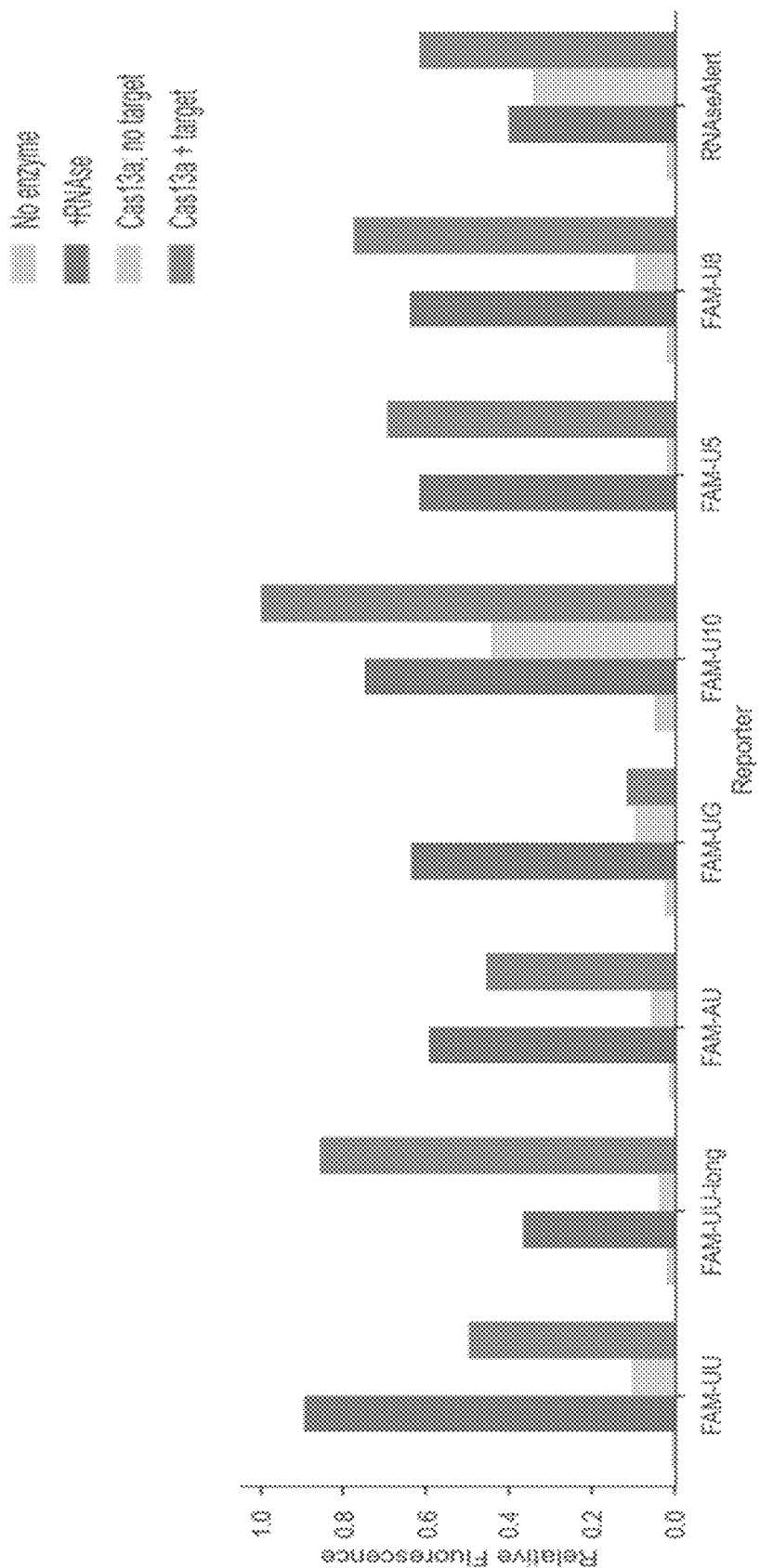
FIG. 1 shows the fluorescent signal of exemplary RNA reporter molecules for use with LbuCas13a. The bars from left to right for each reporter were performed with no enzyme (no LbuCas13a); with RNase A; with LbuCas13a but without a target nucleic acid; or with LbuCas13a and with the target nucleic acid. FAM-UU: /56-FAM/TTrUrUTT (SEQ ID NO: 5)/3IABkFQ/; FAM-UU-long: 56-FAM/TTT-TrUrUTTTT (SEQ ID NO: 4)/3IABkFQ/; FAM-AU: /56-FAM/TArArUGC(SEQ ID NO: 6)/3IABkFQ/; FAM-UG: /56-FAM/TArUrGGC(SEQ ID NO: 7)/3IABkFQ/; FAM-U10: /56-FAM/rUrUrUrUrUrUrUrUrUrU (SEQ ID NO: 3)/3IABkFQ/; FAM-U5: /56-FAM/rUrUrUrUrU (SEQ ID NO: 1)/3IABkFQ/; FAM-U8: /56-FAM/rUrUrUrUrUrUrUrU (SEQ ID NO: 2)/3IABkFQ/; RNAse Alert: Proprietary reporter from Integrated DNA Technologies RNaseAlert Substrate Nuclease Detection System. rU=uracil ribonucleotide; rA=adenine ribonucleotide; rG=guanine ribonucleotide. 56-FAM: 5' 6-Fluorescein dye; 3IABkFQ: 3' Iowa Black FQ.

FIG. 1 shows a bar graph with relative fluorescence on the y-axis ranging from 0 to 1 in increments of 0.2. On the y-axis are different groups including FAM-UU, FAM-UU-long, FAM-AU, FAM-UG, FAM-U10, FAM-U5, FAM-U8, and RNAseAlert. Within each group, from left to right, the bars show no enzyme, +RNAse, Cas13a; no target, and Cas13a+ target.

Figure 2:
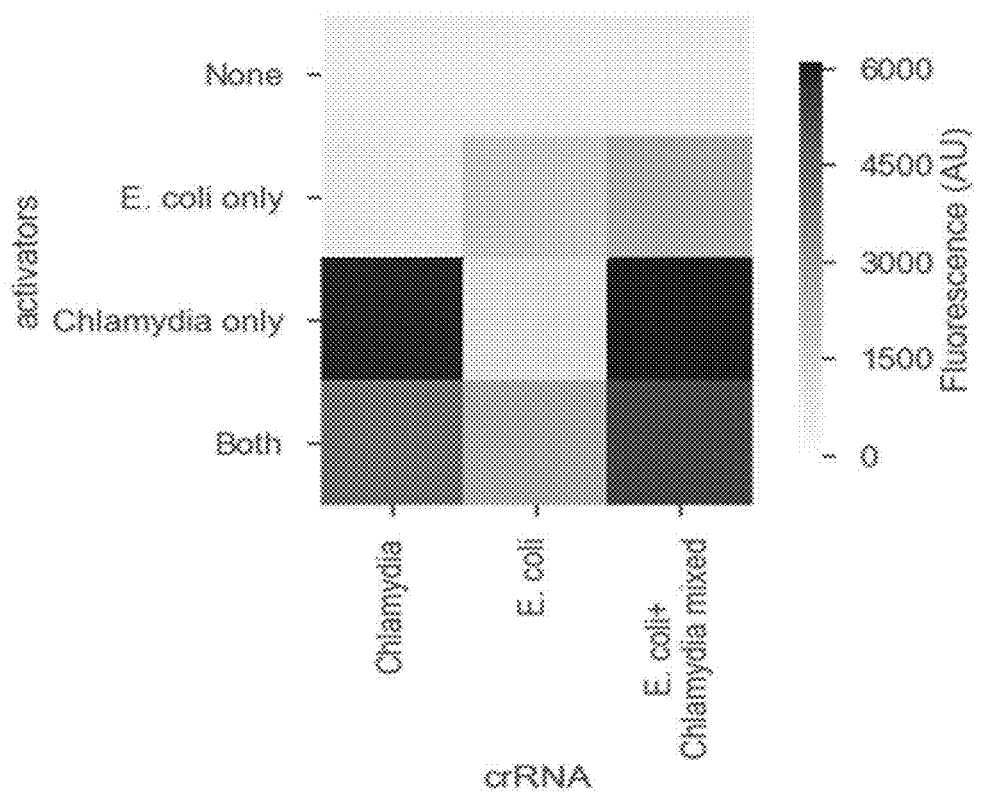
FIG. 2 shows the fluorescent signal of samples with various combinations of no RNA, RNA from *E. coli* only (comprises target RNA from *E. coli*), RNA from *Chlamydia* only (comprises target RNA from *Chlamydia*), or RNA from both *Chlamydia* and *E. coli* (comprises target RNA from *E. coli* and *Chlamydia*) mixed with CRISPR RNAs (crRNAs) for the *Chlamydia* RNA, crRNAs for the *E. coli* RNA, or crRNAs for *Chlamydia* RNA mixed with crRNAs for *E. coli* RNA.

FIG. 2 shows a plot of crRNA along the horizontal edge and activators along the vertical edge. crRNA include, from left to right, *chlamydia*, *E. coli*, and *E. coli+chlamydia* mixed. Activators include, from bottom to top, include both, *chlamydia*, *E. coli* only, and none. The strength of the shading indicates the fluorescence (AU). At right is a scale bar showing lighter shades indicate a lower fluorescence intensity and darker shades indicate a higher fluorescence.

Figure 3:
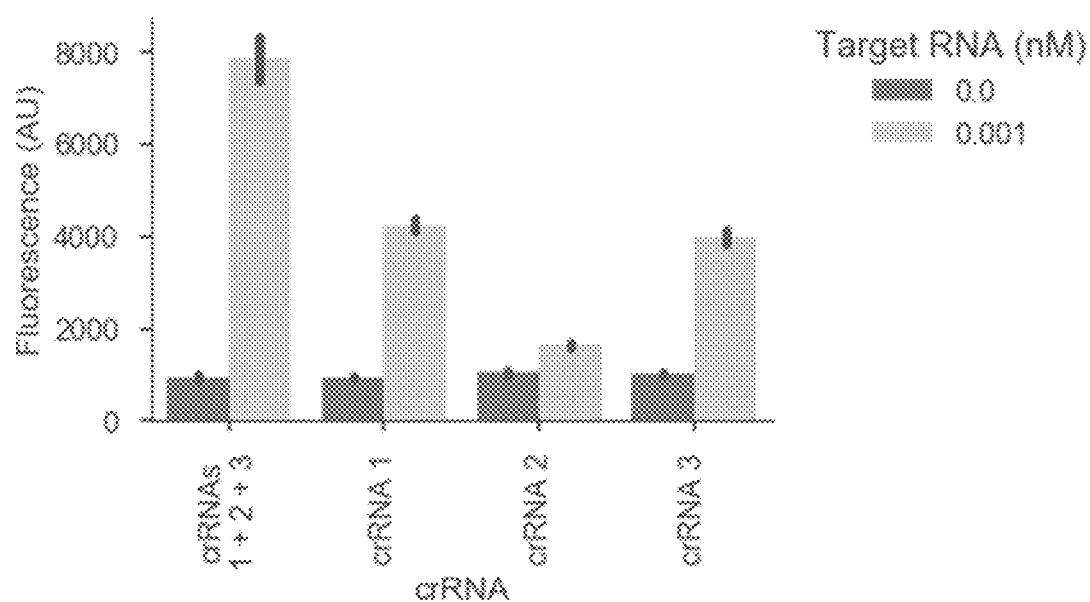
FIG. 3 shows the fluorescent signal for three different crRNAs either individually or as a mixture of all three crRNAs, with either no target RNA or a target RNA with sites for all three crRNAs.

FIG. 3 shows a graph of crRNA on the x-axis and fluorescence (AU) on the y-axis from 0 to 8000 in increments of 2000. crRNA groups include crRNAs 1+2+3, crRNA 1, crRNA 2, and crRNA 3. Within each group is a pair of bars. From left to right the bars are 0.0 nM target RNA and 0.001 nM target RNA.

Figure 4:
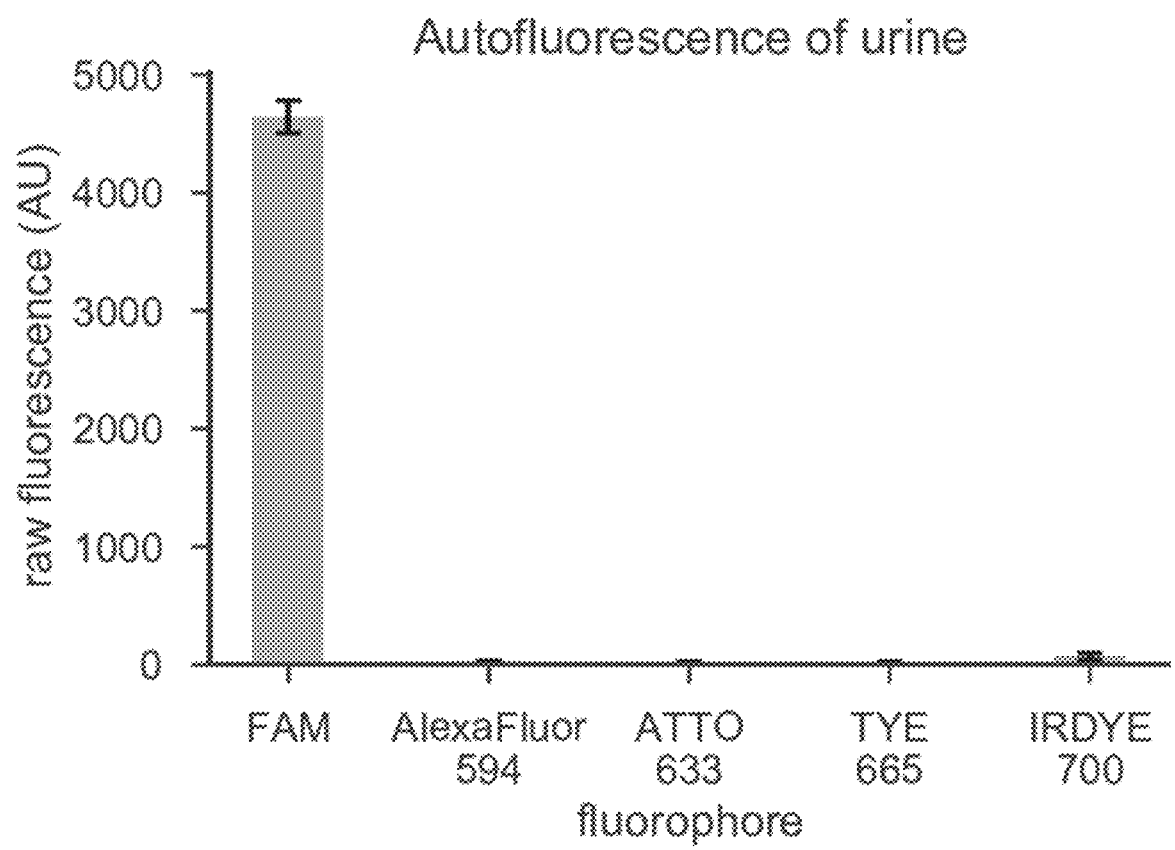
FIG. 4 shows the autofluorescent signal of urine at different wavelengths associated with detection of different fluorophores.

FIG. 4 shows a graph of fluorophore on the x-axis and raw fluorescence (AU) on the y-axis from 0 to 5000 in increments of 1000. The fluorophores shown include FAM, AlexaFluor 594, ATTO 633, TYE 665, and IRDYE 700.

Figure 5A:
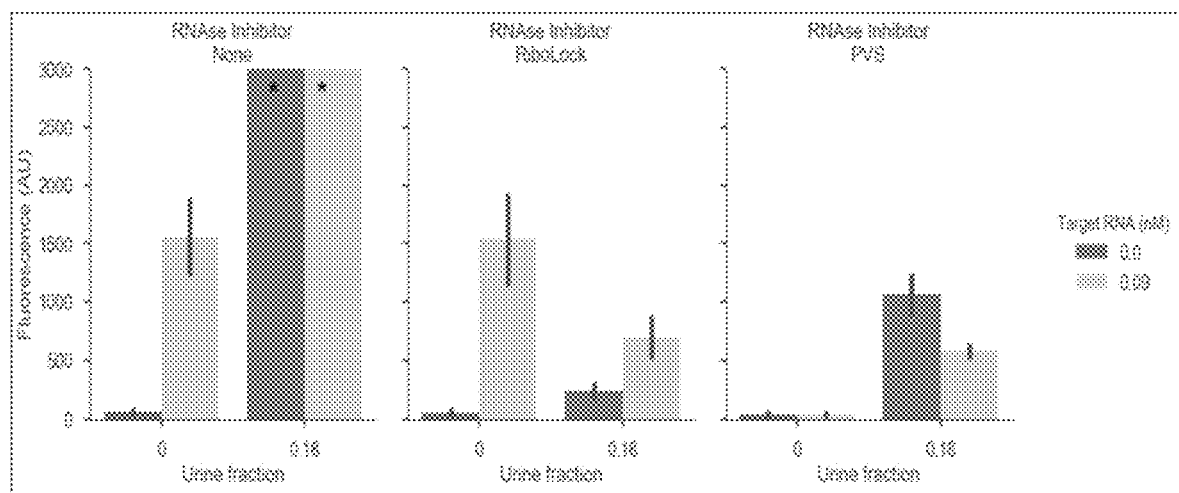
FIG. 5A shows the fluorescent signal of urine with Cas13a and target RNAs with no RNAse inhibitor (left panel), RiboLock RNAse inhibitor (middle panel), and polyvinyl sulfonic acid (PVS) (right panel). Each of these conditions were tested in a urine fraction of 0 (buffer only) or a urine fraction of 0.18 (18% urine in buffer) and either without or with target RNA. * Indicate data was cut-off.

FIG. 5A shows three graphs, which from left to right are titled RNAse inhibitor non, RNAse inhibitor RiboLock, and RNAse inhibitor PVS. The x-axis of each graph shows two groups of urine fraction including "0" and "0.18". Shown on the y-axis of each graph is fluorescence (AU) from 0 to 3000 in increments of 500, Within each urine fraction group are a pair of bars, which from left to right are 0.0 nM target RNA and 0.09 nM target RNA.

Figure 5B:
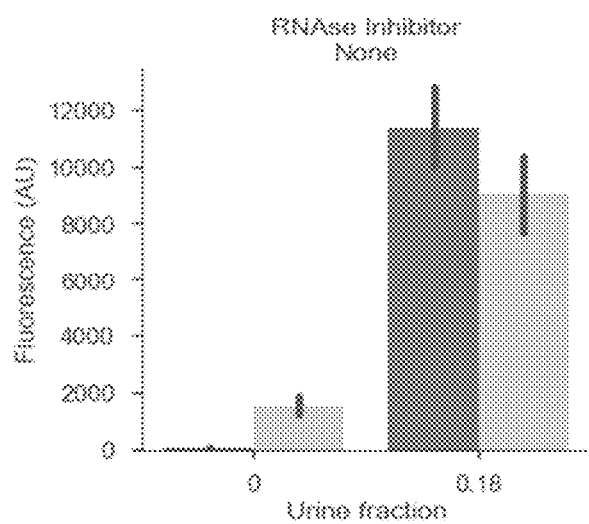
FIG. 5B shows a rescaled y-axis for the left panel of FIG. 5A.

FIG. 5B shows a graph titled RNAse inhibitor None. The x-axis of the graph shows two groups of urine fraction including "0" and "0.18". Shown on the y-axis of each graph is fluorescence (AU) from 0 to 12000 in increments of 2000. Within each urine fraction group are a pair of bars, which from left to right are 0.0 nM target RNA and 0.09 nM target RNA.

Figure 6:
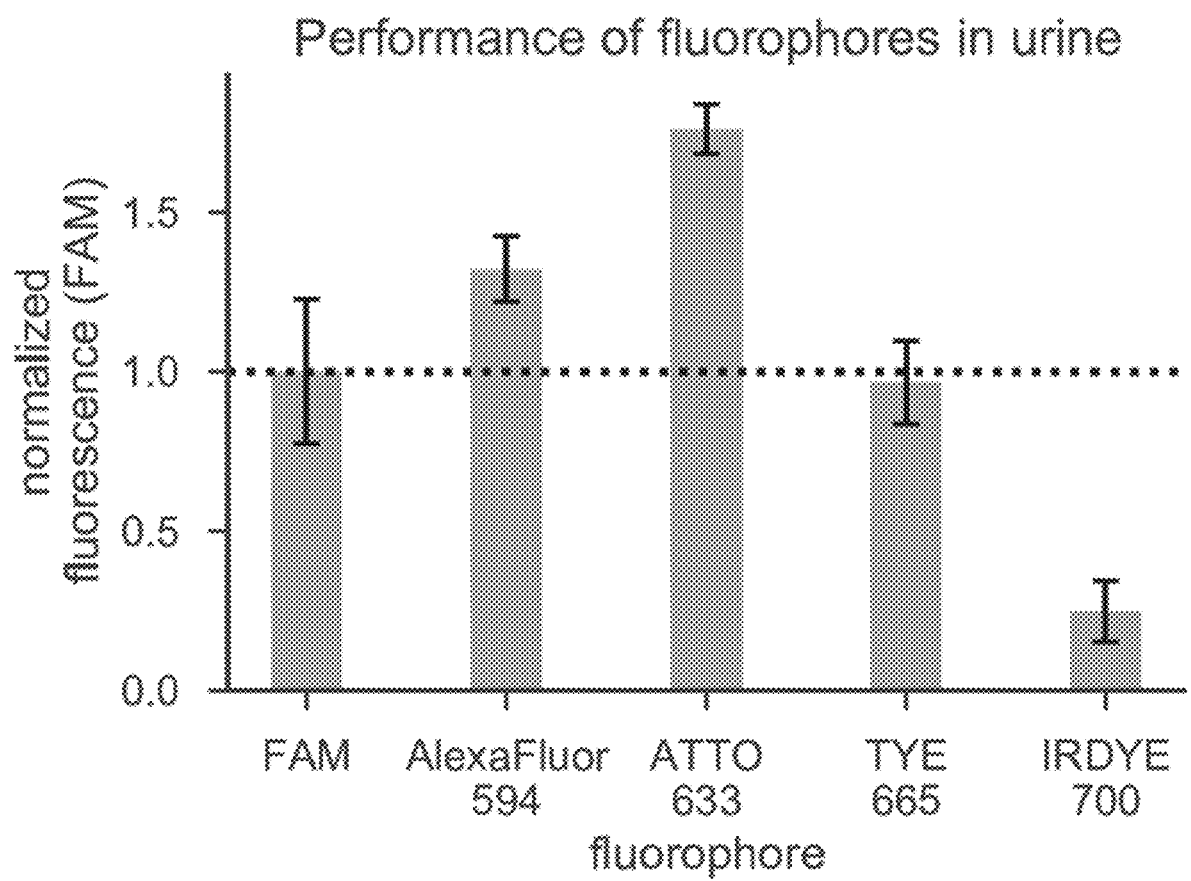
FIG. 6 shows the normalized fluorescence signal of FAM, AlexaFluor594, ATTO633, TYE665, and IRDYE700 fluorophores in human urine, which was normalized against the ratio of fluorescence between urine with or without RNase inhibitor for the FAM fluorophore.

FIG. 6 shows a graph titled performance of fluorophores in urine. The x-axis of the graph shows fluorophores including, from left to right, FAM, AlexaFluor 594, ATTO 633, TYE 665, and IRDYE 700. On the y-axis is normalized fluorescence (FAM) from 0 to 1.5 in increments of 0.5.

Figure 7A:
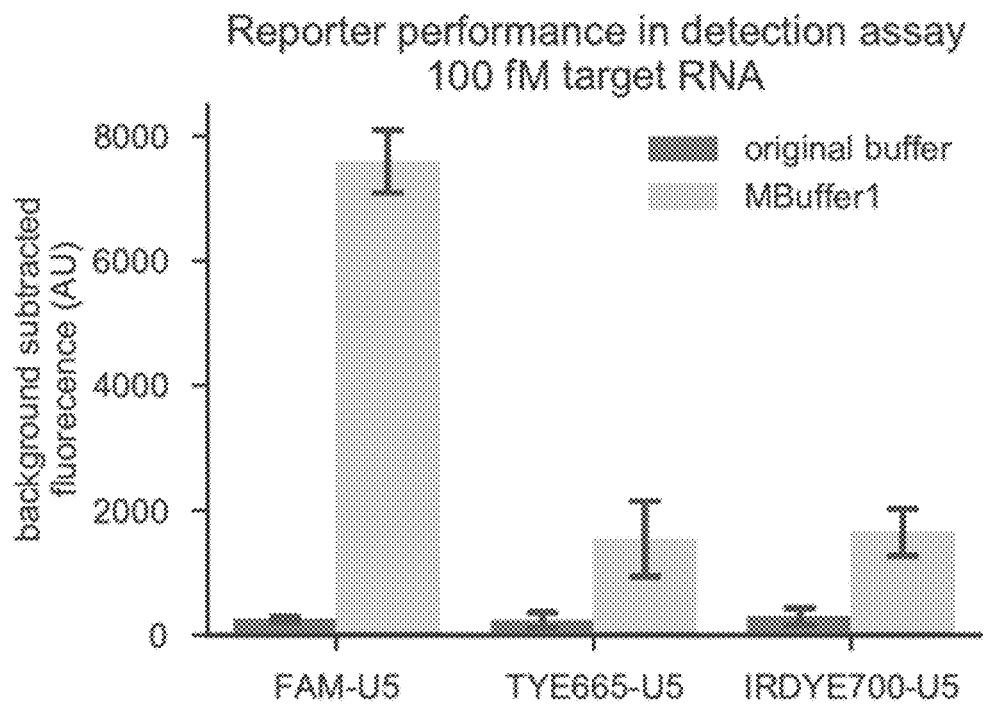
FIG. 7A shows the background subtracted fluorescent signal of RNA reporter molecules with Cas13a and 100 fM of target RNA in either the original Cas13a buffer or an enhanced buffer (MBuffer1). FAM-U5: /56-FAM/rUrUrUrUrU (SEQ ID NO: 1)/3IABkFQ/; TYE665-U5: /5TYE665/rUrUrUrUrU (SEQ ID NO: 1)/3IAbRQSp/; IRDYE700-U5: /5IRD700/rUrUrUrUrU (SEQ ID NO: 1)/3IRQC1N/. rU=uracil ribonucleotide. 56-FAM: 5' 6-Fluorescein dye; 3IABkFQ: 3' Iowa Black FQ; 5TYE665: 5' TYE 665; 3IAbRQsp: 3' Iowa Black RQ; 5IRD700: 5' IRDye 700; 3IRQC1N: IRDye QC-1 quencher.

FIG. 7A shows a graph entitled "Reporter performance in detection assay 100 fM target RNA". Shown on the x-axis are three groups including FAM-U5, TYE665-U5, and IRDYE700-U5. Shown on the y-axis is background subtracted fluorescence (AU) from 0 to 8000 in increments of 2000. Within each group is a pair of bars, which from left to right, are original buffer and MBuffer1.

Figure 7B:
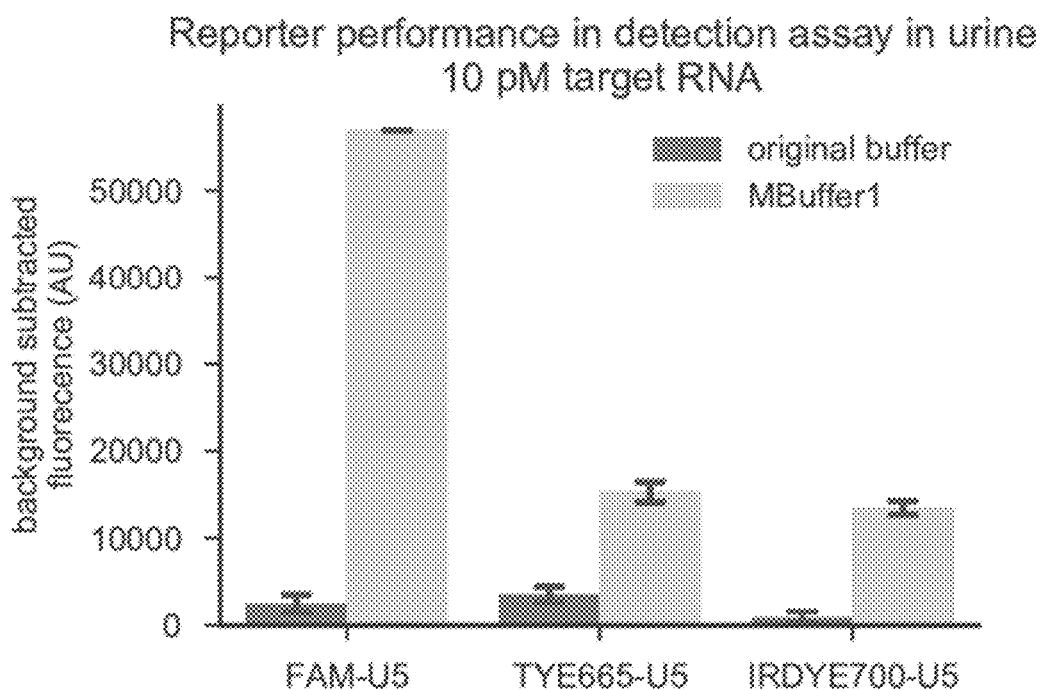
FIG. 7B shows the background subtracted fluorescent signal of RNA reporter molecules with Cas13a and 10 pM of target RNA in either the original Cas13a buffer or an enhanced buffer (MBuffer1) in urine. FAM-U5: /56-FAM/rUrUrUrUrU (SEQ ID NO: 1)/3IABkFQ/; TYE665-U5: /5TYE665/rUrUrUrUrU (SEQ ID NO: 1)/3IAbRQSp/; IRDYE700-U5: /5IRD700/rUrUrUrUrU (SEQ ID NO: 1)/3IRQC1N/. rU=uracil ribonucleotide. 56-FAM: 5' 6-Fluorescein dye; 3IABkFQ: 3' Iowa Black FQ; 5TYE665: 5 TYE 665; 3IAbRQsp: 3' Iowa Black RQ; 5IRD700: 5' IRDye 700; 3IRQC1N: QC-1 quencher.

FIG. 7B shows a graph entitled "Reporter performance in detection assay in urine 10 pM target RNA". Shown on the x-axis are three groups including FAM-U5, TYE665-U5, and IRDYE700-U5. Shown on the y-axis is background subtracted fluorescence (AU) from 0 to 50000 in increments of 10000. Within each group is a pair of bars, which from left to right, are original buffer and MBuffer1.

Figure 8A:
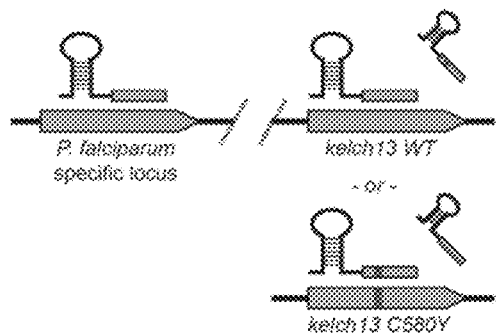
FIG. 8A is a schematic showing a guide nucleic acid (gRNA) for detection of a species-specific locus of *P. falciparum*, a gRNA for detection of a WT allele of kelch13, and a gRNA for detection of a C580Y allele of kelch13. The gRNA for detection of a WT allele of kelch13 binds to the WT allele of kelch13, but does not bind to the kelch13 C580Y allele. The gRNA for detection of the kelch13 C580Y allele binds to the kelch13 C580Y allele, but does not bind to the kelch13 WT allele.

FIG. 8A shows a schematic of guide RNA (gRNA) above, and binding to, a species-specific locus of *P. falciparum*, a gRNA above, and binding to, a WT allele of kelch13, and a gRNA above, and binding to, a C580Y allele of kelch13. The gRNA for detection of a WT allele of kelch13 binds to the WT allele of kelch13, but does not bind to the kelch13 C580Y allele. The gRNA for detection of the kelch13 C580Y allele binds to the kelch13 C580Y allele, but does not bind to the kelch13 WT allele.

Figure 8B:
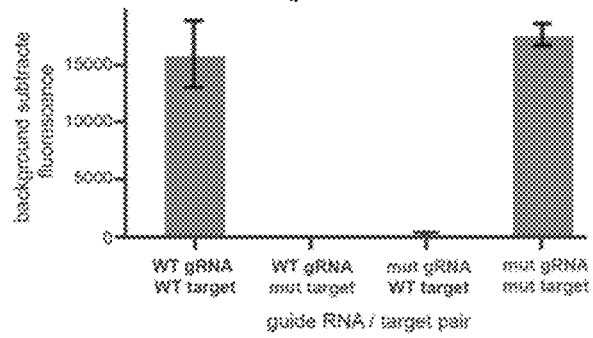
FIG. 8B shows Cas12a is capable of discriminating between WT and a SNP responsible for Artemisinin resistance in *P. falciparum*. For the WT, the gRNA that binds to the WT nucleic acid molecule (WT gRNA) produces fluorescence in the presence of the WT target nucleic acid molecule (WT target) but not in the presence of the target nucleic acid molecule comprising the SNP (mut target). For the SNP, the gRNA that binds to the target nucleic acid molecule comprising the SNP (mut gRNA) produces fluorescence in the presence of the target nucleic acid molecule comprising the SNP (mut target), but not in the presence of the WT target.

FIG. 8B shows a graph entitled "Cas12a discrimination between WT and single-nucleotide mutation. The x-axis shows guide RNA/target pair groups and the y-axis shows background subtracted fluorescence from 0 to 15000 in increments of 5000. The guide RNA/target pair groups include WT gRNA WT target, WT gRNA mut target, mut gRNA WT target, and mut gRNA mut target.

Figure 8C:
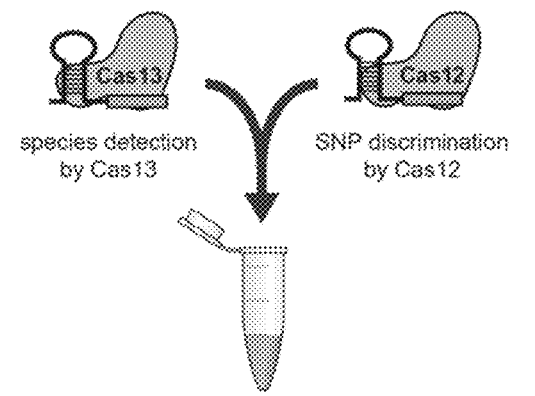
FIG. 8C shows species-specific detection of 16 S of N. gonorrhea by Cas13 using a reporter molecule (/5-6FAM/rUrUrUrUrU (SEQ ID NO: 1)/3IABkFQ/) and detection of an azithromycin resistance SNP for N. gonorrhea (23 S mutant) versus wild-type (23 S WT) N. gonorrhea by Cas12 using a reporter molecule (/AF594/TTATTATT/3IAbRQSp/), all in a single reaction. The top grid shows detection of N. gonorrhea using a Cas13 species-specific 16 S gRNA and detection of WT 23 S using a Cas12 gRNA targeting the 23 S WT, indicating the N. gonorrhea is susceptible to antibiotic treatment using azithromycin. The bottom grid shows detection of N. gonorrhea using a Cas13 species-specific 16 S gRNA and detection of mutant 23 S using a Cas12 gRNA targeting the 23 S mutant, indicating the N. gonorrhea is resistant to antibiotic treatment using azithromycin.
Figure 8C:
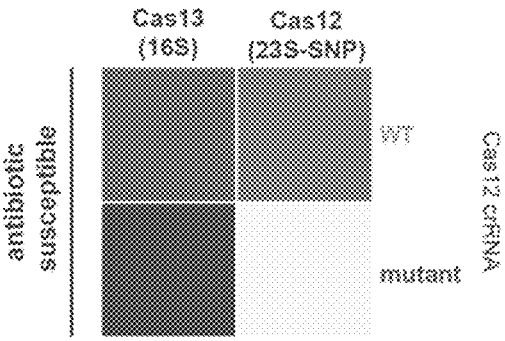
Figure 8C:
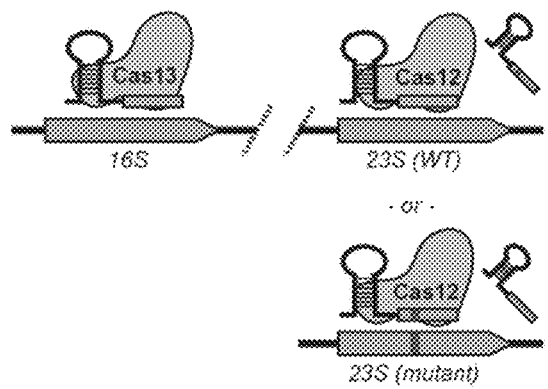
Figure 8C:
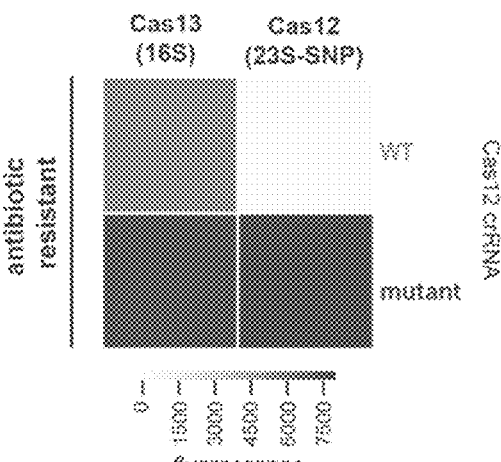

FIG. 8C at left shows a schematic, which from top to bottom shows a Cas13/gRNA complex (which functions for species detection) and a Cas12/gRNA complex (which functions for SNP discrimination) being added to an eppendorph. The Cas13/gRNA complex bound to the 16 S region of the target gene and the Cas12/gRNA complex is shown bound to the 23 s (WT) or 23 S (mutant) region of the target gene (depending on the composition of the gRNA). Cas12/gRNA complexes specific to the mutant do not bind the wild type and Cas12/gRNA complexes specific to the wild type do not bind the mutant. At the right are grid plots of *N. gonorrhoeae* infection. At the top right is a grid plot, titled antibiotic susceptible, with Cas13 (16 S) in the left column, Cas12 (23 S-SNP) in the right column, WT in the top row, and mutant in the bottom row. Cas12 crRNA was used. The darker a quadrant, the higher the fluorescence, as indicated in the scale bar at the very bottom right of the image. The scale bar shows fluorescence from 0 to 7500 in increments of 1500. At the bottom right is a grid plot, titled antibiotic resistant, with Cas13 (16 S) in the left column, Cas12 (23 S-SNP) in the right column, WT in the top row, and mutant in the bottom row. Cas12 crRNA was used. The darker a quadrant, the higher the fluorescence, as indicated in the scale bar at the very bottom right of the image.

FIG. 9 shows a schematic, which from left to right shows, Steps 1 to 4 of a workflow. Under Step 1 is "sample preparation" in an oval. Under Step 2 is "nucleic acid amplification" in an oval. Under Step 3 is "programmable nuclease reaction incubation" in a rectangle. Under Step 4 is "detection (readout)" in a rectangle.

FIG. 10 depicts at right a filtration device shaped like a syringe. At left are three samples, which from top to bottom are cheek/facial swab, urine specimen collector, and fingerprint.

FIG. 11 shows at top a schematic entitled "device 2.1—essentials elements only/no amplification". A sample is depicted entering through P1, which is connected vertically below to V1. V1 is adjacent to V2, which is connected vertically above to P2 through which pre-complexed programmable nuclease mix is introduced. To the right of V1 is a twisted region labeled S1. To the right of S1 is an incubation and detection chamber, labeled C1. To the right of C1 is V3, which is connected vertically above to P3, which is the collection outlet. Shown in the middle of the schematic is a fluidic device entitled "device 2.2—one-chamber reaction with amplification. A sample is depicted entering through P1, which is connected vertically below to V1. V1 is adjacent to V2, which is connected vertically above to P2 through which amplification mix is introduced. V2 is adjacent to V2, which connected vertically above to P3 through which pre-complexed programmable nuclease mix is introduced. To right of V3 is a twisted region labeled S1. To the right of S1 is an incubation and detection chamber, labeled C1. To the right of C1 is V4, which is connected vertically above to P4, which is the collection outlet. Shown at bottom is another fluidic device entitled "device 2.3—two-chamber reaction with amplification". A sample is depicted entering through P1, which is connected vertically below to V1. V1 is adjacent to V2, which is connected vertically above to P2 through which amplification mix is introduced. To the right of V2 is a twisted region labeled S1. To the right of S1 is an incubation chamber labeled C1. To the right of C1 is V3, which is connected vertically above to P3, through which pre-complexed programmable nuclease mix is introduced. To the right of V3 is another serpentine region labeled S2. To the right of S2 is an incubation and detection chamber labeled C2. To the right of C2 is V4, which is connected vertically above to P4, which is the collection outlet.

FIG. 12 shows at top is "(a) fluorescence readout" and depicts a rectangular chip substrate surface with a thin film planar heater shown as a colored in rectangular region. Above the chip is a drawing of a fluorescence excitation/detection apparatus. Shown below is a "(b) electrochemical readout". The electrochemical readout shows two schematics. The top schematic is titled "solid-phase detection using streptavidin signal amplification". At left is a rectangular surface depicting the top chamber surface coated with ssDNA labeled with biotin, which is shown as stars. Directly below is an electrode surface with streptavidin, which is shown as hexagons. Shown to the right of the functionalized chambers is a graph of voltage on the x-axis versus current on the y-axis, where the graph is titled "LOW". To the right is an arrow showing introduction of a programmable nuclease, which is depicted as a pair of scissors, and which is shown to cleave the biotin off the top surface. The biotin is depicted as attached to the streptavidin. Shown further to the right is a graph of voltage on the x-axis versus current on the y-axis, where the graph is titled "HIGH". Shown below is the second schematic titled "solid-phase detection using immobilized electroactive oligos". Shown at the left of the schematic is a rectangular electrode surface with ssNA/Fc-NTP. The surface is functionalize with electroactive moieties depicted as tree-like structures with ferrocene shown in circles. To the right is a graph of voltage on the x-axis versus current on the y-axis and where the graph is titled "HIGH". Further to the right is an arrow showing introduction of a programmable nuclease, which is depicted as a pair of scissors, and which is shown to cleave the Fc circles. Further to the right is a graph of voltage on the x-axis versus current on the y-axis and where the graph is titled "LOW".

FIG. 13 shows a sample being introduced at P1, which is connected vertically below to V1. V1 is adjacent to V2, which is connected vertically above to isothermal amplification mix. To the right of V2 is a serpentine channel labeled S1. Further to the right is an incubation chamber labeled C1. To the right of C1 is V3, which is connected vertically above to P3, through which pre-complexed programmable nuclease mix is introduced. To the right of V3 is another serpentine channel labeled S2 and further to the right is another incubation chamber labeled C2. To the right of C2 is V4, which is connected vertically above to P4 through which sucrose or a colorimetric reagent is introduced. To the right of V4 is another serpentine channel labeled S3 and further to the right is a detection chamber labeled C3 To the right of C3 is V5, which is connected vertically above to P5. Below is an exploded view diagram of the C2 incubation chamber. The schematic is of a top chamber depicted as a rectangle with a label reading "top chamber surface coated with ssNA conjugated to invertase. Invertase is shown in rectangular boxes labeled "Inv". Below the top chamber is a structure showing a bottom chamber surface with a thin-film planar heater. Further to the right is an arrow showing introduction of a programmable nuclease, which is depicted as a pair of scissors, and which is shown to cleave the Invertase. Further below is an exploded view diagram of the detection chamber labeled C3. This exploded view diagram shows at top a schematic labeled "(a) optical readout using DNS, or other compound". At top is "(a) optical readout using DNS, or other compound" and depicts a rectangular chip substrate surface with a thin film planar heater shown as a colored in rectangular region. Above the chip is a camera, or optical sensor. At bottom is "(b) electrochemical readout (electrochemical analyzer or glucometer", which from left to right shows an electrode surface with immobilized glucose oxidase, which is depicted as a rectangle with an oval labeled "GOx". Above the functionalized electrode surface is a flow diagram which from left to right shows sucrose, an arrow to the right with "Inv" directly above it, and fructose+glucose at the right. To the right of the functionalized electrode surface is a graph of voltage on the x-axis versus current on the y-axis, below which is an electronic reader indicating "LOW". Further to the right is glucose interacting with the GOx functionalized electrode surface resulting in H2)2+F-glucono-δ-lactone. To the right is a graph of voltage on the x-axis versus current on the y-axis, below which is an electronic reader indicating "HIGH". Below is a key showing that an invertase-labeled oligo is depicted as a line with a rectangle labeled "Inv". Programmable nuclease is depicted as a pair of scissors. The molecular structure of DNS is shown. Glucose oxidase is an oval labeled as GOx.

FIG. 14B depicts a bar graph of the detection of prostate cancer RNA biomarkers. The graph shows three sets of three bars, the three sets corresponding to, from left to right, RNA #1, RNA #2, and RNA #3, as denoted by the x-axis. The y-axis shows background subtracted fluorescence (AU) from 0 to 140,000 in increments of 20,000. The three bars in each set correspond to, from left to right, prostate cancer cell line, cervical cancer cell line, and water. In each set the bar corresponding to the prostate cancer cell line is the highest. In all three sets, the bar corresponding to water is not visible. The bar corresponding to the cervical cancer cell line is not visible in the RNA #2 set.

Figure 20A:
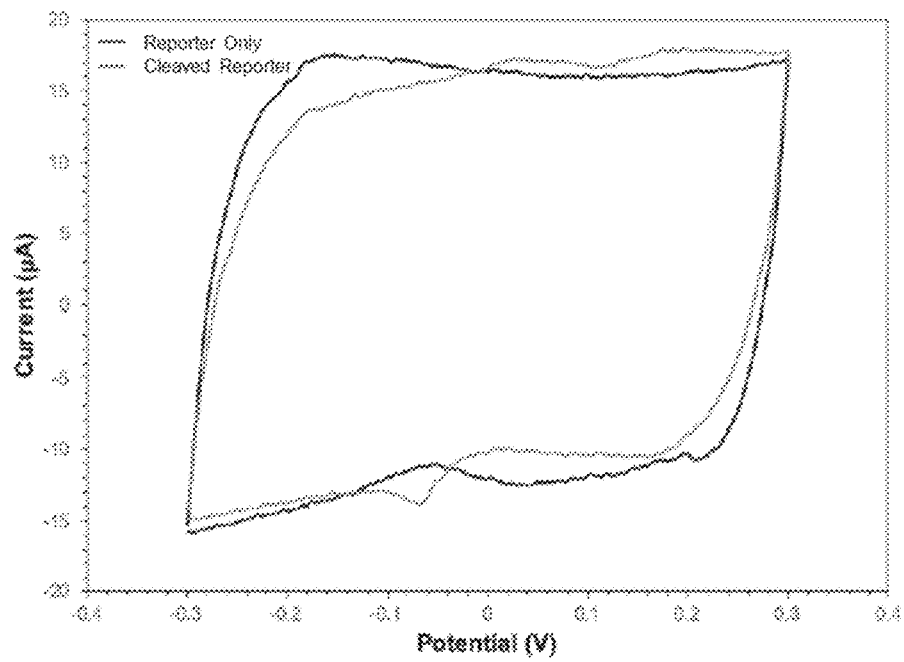
FIG. 20A shows a cyclic voltammogram showing potential (V) on the x-axis versus current (µA) on the y-axis for the reporter only versus a cleaved reporter.

FIG. 20A shows a line graph depicting the current as a function of potential. Potential (V) is shown on the x-axis from −0.4 to 0.4 in increments of 0.1. Current (μA) is shown on the y-axis from −20 to 20 in units of 5. The graph depicts two sets of two lines. Each set of two lines includes one line corresponding to Reporter Only (darker line) and the other corresponding to Cleaved Reporter (lighter line). In the upper left corner of the graph, the Reporter Only line is higher than the Cleaved Reporter line at lower potential, and the Cleaved Reporter line is higher than the Reporter Only line at higher potential. In the lower right corner of the graph, the Cleaved Reporter line is higher than the Reporter Only line for all potential values except for from about −0.1 to about −0.04.

Figure 20B:
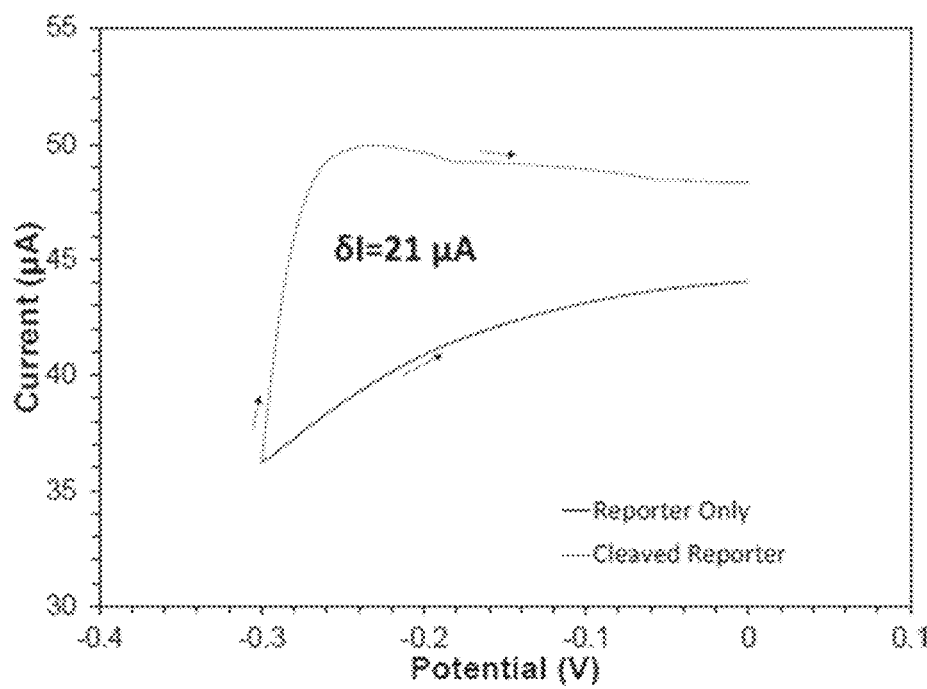
FIG. 20B shows a square wave voltammogram showing potential (V) on the x-axis versus current (µA) on the y-axis for the reporter only versus a cleaved reporter.

FIG. 20B shows a line graph depicting the current as a function of potential. Potential (V) is shown on the x-axis from −0.4 to 0.1 in increments of 0.1. Current (μA) is shown on the y-axis from 30 to 55 in units of 5. The graph depicts two lines corresponding to Reporter Only (darker line) and Cleaved Reporter (lighter line). The Cleaved Reporter line is higher than the Reporter only line at all potential values.

Figure 27:
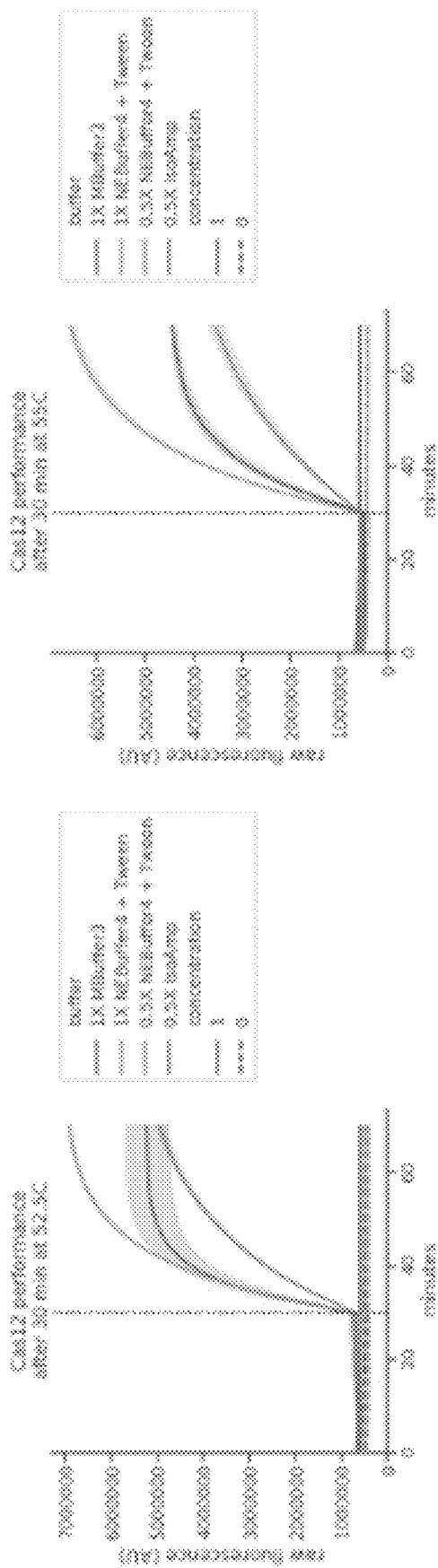
FIG. 27 shows that the stability of Cas12M08 at elevated temperatures is dependent on the buffer composition.

FIG. 27 shows two line graphs corresponding to Cas12 performance after 30 min at 52.5 C on the left and Cas12 performance after 30 min at 55 C on the right. Each plot depicts four sets of four lines, the first set corresponding to 1× MBffer3, 1× NE Buffer 4+Tween, 0.5× IsoAmp, all at a concentration of 1 (solid lines), and the second set corresponding to 1× MBffer3, 1× NE Buffer 4+Tween, 0.5× NE Buffer 4+Tween, 0.5× IsoAmp, all at a concentration of 0 (dashed lines). In the left plot, the x-axis show time in minutes from 0 to 60 in increments of 20, and the y-axis shows raw fluorescence (AU) from 1,000,000 to 7,000,000 in increments of 1,000,000. From 0 to about 30 minutes (30 minutes denoted by a vertical dashed line), all lines are substantially overlapping below 1,000,000 AU. After 30 minutes, the lines corresponding to 1× MBffer3, 1× NE Buffer 4+Tween, 0.5× NE Buffer 4+Tween, all at a concentration of 1, rise rapidly above baseline. The line corresponding to 0.5× NE Buffer 4+Tween at a concentration of 1 is the highest, followed by 1× MBffer3 at a concentration of 1, the by 1× NE Buffer 4+Tween at a concentration of 1. In the right plot, the x-axis show time in minutes from 0 to 60 in increments of 20, and the y-axis shows raw fluorescence (AU) from 1,000,000 to 6,000,000 in increments of 1,000,000. From 0 to about 30 minutes (30 minutes denoted by a vertical dashed line), all lines are substantially overlapping below 1,000,000 AU. After 30 minutes, the lines corresponding to 1× MBffer3, 1× NE Buffer 4+Tween, 0.5× NE Buffer 4+Tween, all at a concentration of 1, rise rapidly above baseline. The line corresponding to 0.5× NE Buffer 4+Tween at a concentration of 1 is the highest, followed by 1× MBffer3 at a concentration of 1, the by 1× NE Buffer 4+Tween at a concentration of 1.

Figure 30:
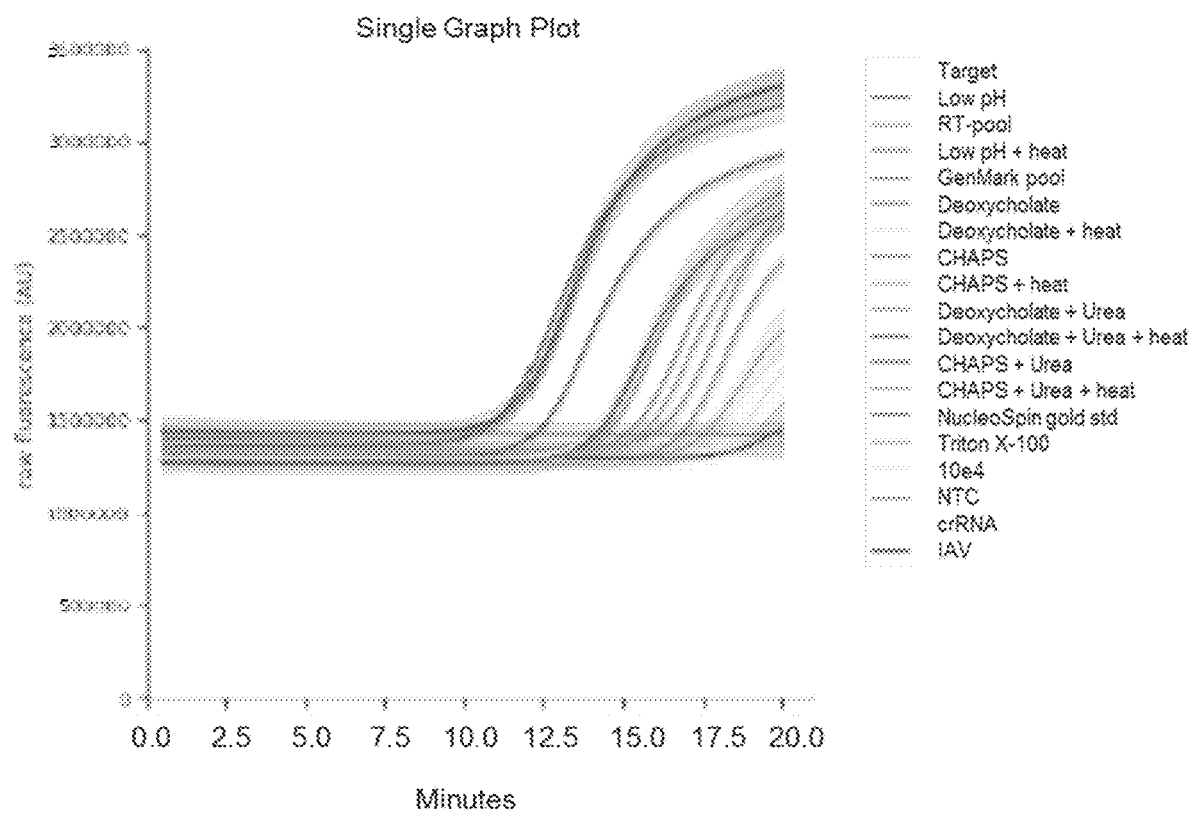
FIG. 30 shows extraction buffers used to extract Influenza A RNA from remnant clinical samples.

FIG. 30 depicts a line graph of raw fluorescence over time. The x-axis shows time in minutes from 0.0 to 20.0 in increments of 2.5. The y-axis shows raw fluorescence from 0 to 3,500,000 in increments of 500,000. The lines depict targets corresponding to Low pH, RT-pool, Low pH+heat, GenMark pool, Deoxycholate, Deoxycholate+heat, CHAPS, CHAPS+heat, Deoxycholate+Urea, Deoxycholate+Urea+heat, Nucleospin gold std, Triton X-100, 10e4, and NTC. The cRNA is IAV. The highest lines on the graph correspond to RT-pool, Low pH, and GenMark pool. The remaining lines, in order from upper left to lower right, correspond to NucleoSpin gold std, Deoxycholate and CHAPS+Urea (approximately equal), Low pH+heat, CHAPS+heat, CHAPS+Urea+heat, Triton X-100, Deoxycholate+Urea, 10e4, and Deoxycholate+Urea+heat. NTC is a flat line at about 1,500,000.

Figure 31:
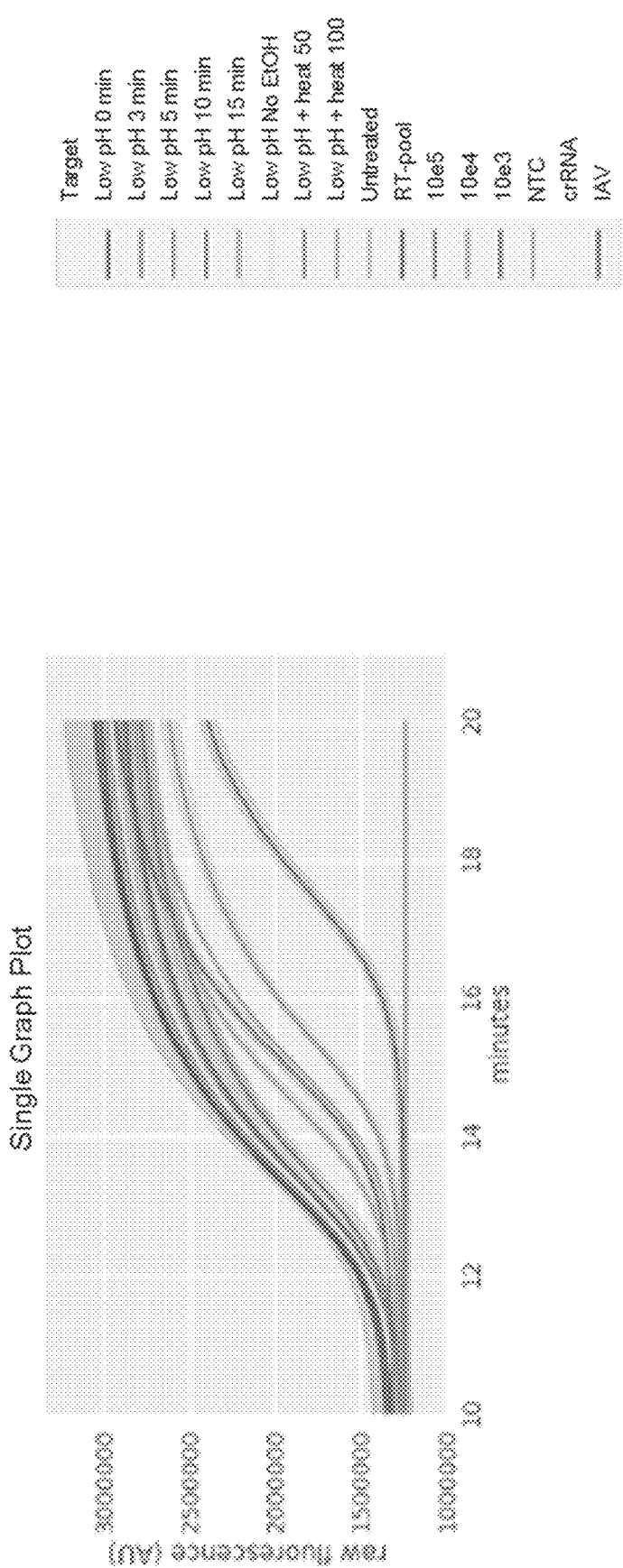
FIG. 31 shows that low pH conditions allow for rapid extraction of Influenza A genomic RNA.

FIG. 31 depicts a line graph of raw fluorescence over time. The x-axis shows time in minutes from 0.0 to 20.0 in increments of 2.5. The y-axis shows raw fluorescence from 1,000,000 to 3,000,000 in increments of 1,000,000. The lines depict targets corresponding to Low pH 0 min, Low pH 3 min, Low pH 5 min, Low pH 10 min, Low pH 15 min, Low pH No EtOH, Low pH+heat 50, Low pH+heat 100, Untreated, RT-pool, 10e5, 10e4, 10e3, and NTC. The crRNA is IAV. The two highest lines correspond to Low pH 0 min and RT-pool. The remaining lines, from upper left to lower right, correspond to Low pH 5 min, Low pH No EtOH, Low pH 15 min, Low pH 10 min, 10e5, Low pH+heat 100, Low pH+heat 50, Untreated, 10e4, 10e3, and NTC.

Figure 36:
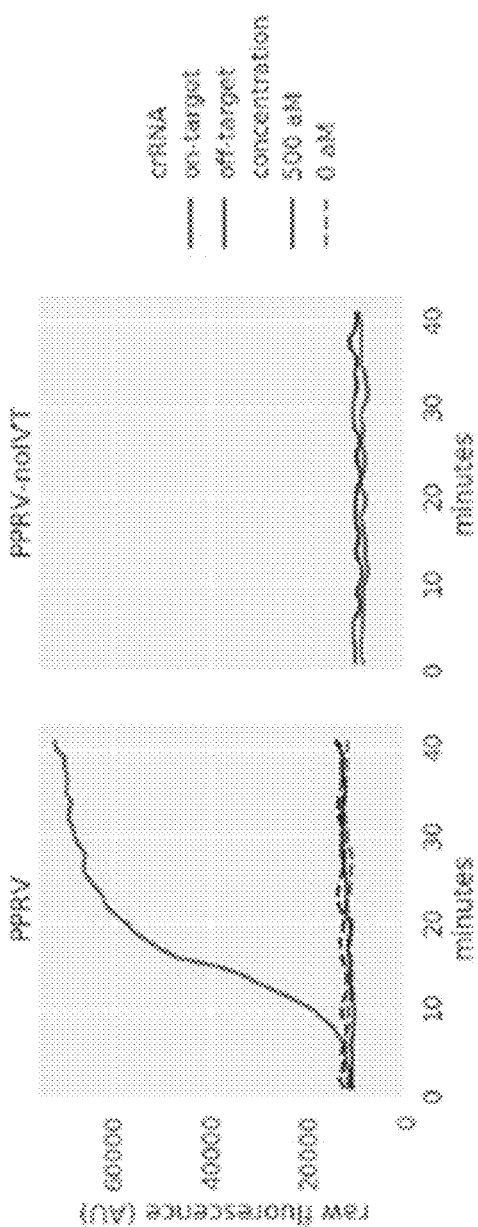
FIG. 36 shows the specific detection of viral RNA from the Peste des petits ruminants (PPR) virus that infects goats using the one-pot Cas13a assay. The schematic at left shows the workflow including providing DNA/RNA and RPA/RT-RPA, in vitro transcription, and Cas13a detection. The graphs at right show the results of Cas13a detection as measured by fluorescence over time for the tested conditions.
Figure 36:
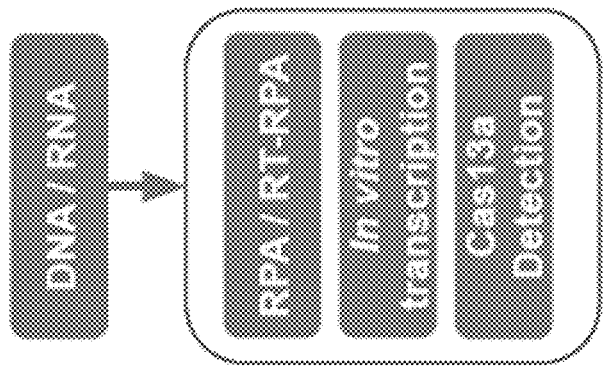

FIG. 36 depicts a flow chart and two line graphs. The flow chart shows four boxes. The top box reads "DNA/RNA." The remaining three boxes read, from top to bottom, "RPA/RT-RPA," "In vitro transcription," and "Cas13a Detection." Both plots show raw fluorescence over time. The x-axis shows minutes from 0 to 40 in increments of 10. The y-axis shows raw fluorescence (AU) from 0 to 60,000 in increments of 20,000. Both plots show two sets of two lines corresponding to on-target and off-target each at 500 aM (solid lines), and on-target and off-target each at 0 aM (dashed lines). The left plot depicts PPRV. In the left plot, the line corresponding to on-target at 500 aM rises over time. The remaining lines appear approximately flat. The right plot shows PPRV-noIVT. All four lines are approximately flat.

Figure 38:
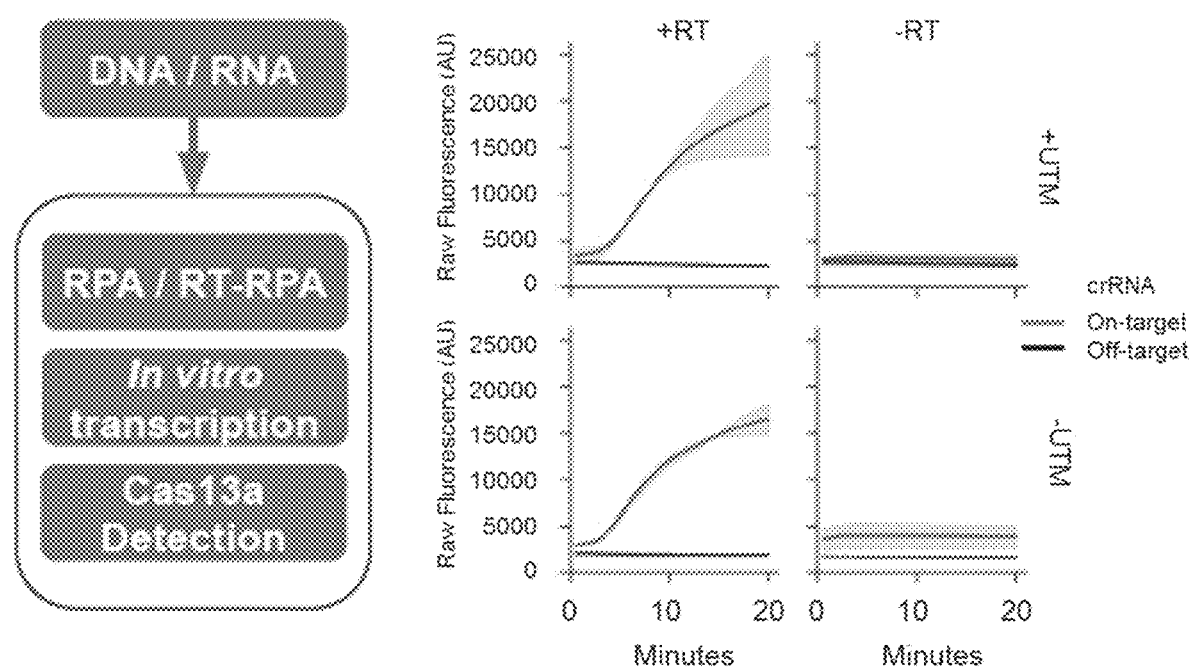
FIG. 38 shows the tolerance of the one-pot Cas13a assay for the detection of RNA from the Influenza B virus in the presence and in the absence of a universal viral transport medium called universal transport media (UTM Copan) at 40° C. The schematic at left shows the workflow including providing DNA/RNA and RPA/RT-RPA, in vitro transcription, and Cas13a detection. The graphs at right show the results of Cas13a detection over time for each tested condition.

FIG. 38 depicts a flow chart and four line graphs. The flow chart shows four boxes. The top box reads "DNA/RNA." The remaining three boxes read, from top to bottom, "RPA/RT-RPA," "In vitro transcription," and "Cas13a Detection." All four plots show raw fluorescence over time. The x-axis of all four plots shows minutes from 0 to 20 in increments of 10. The y-axis of all four plots shows raw fluorescence (AU) from 0 to 25,000 in increments of 5,000. All four plots show two lines corresponding to crRNA on-target and off-target. The upper left plot shows +RT and +UMT. The on-target line rises over time, and the off-target line appears approximately flat. The lower left plot shows +RT and −UMT. The on-target line rises over time, and the off-target line appears approximately flat. The upper right plot shows −RT and +UMT. Both lines appear approximately flat. The lower right plot shows −RT and −UMT. Both lines appear approximately flat, but the on-target line is above the off-target line.

FIG. 41B shows a bar graph depicting time to result (lower is better). The graph shows six sets of four bars each. The six sets of bars correspond to temperatures (C) of, from left to right, of 74, 72, 70, 68, 66, and 64, as shown on the x-axis. The four bars in each set show, from left to right, Hela-total-RNA, Mouse-liver-RNA, Hela-DNA, and NTC. The y-axis shows time to result (minutes) from 0 to 40 in increments of 5. At all six temperatures, the bars corresponding to Mouse-liver-RNA and NTC have a time to result of 40 or more. At all six temperatures, Hela-total-RNA is the next highest, and Hela-DNA is the lowest.

FIG. 41C depicts three line graphs corresponding to, from left to right, crRNA=off-target, crRNA=on-target #1, and crRNA=on-target #2. For all three plots, the x-axis shows minutes from 0 to 75 in increments of 25, and the y-axis shows raw fluorescence (AU) from 0 to 1,500,000 in increments of 500,000. Each plot depicts three lines corresponding to Targets, the lines representing Hela-RNA, Hela-DNA, Mouse-liver RNA, and NTC. On the left plot and the right plot, all four lines are approximately flat. In the middle plot, the lines corresponding to Hela-DNA and Hela-RNA rise over time, with Hela-DNA being the highest. Mouse-liver-RNA and NTC are the lowest.

Figure 42:
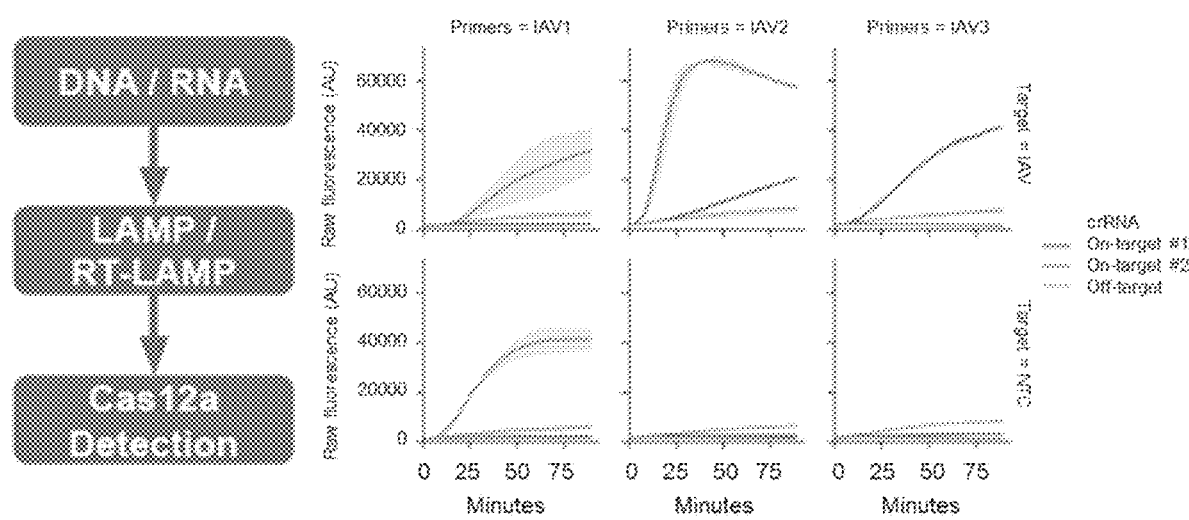
FIG. 42 shows the specific detection of three different RT-LAMP amplicons for Influenza A virus. At left is a schematic of the workflow including providing DNA/RNA, LAMP/RT-LAMP, and Cas12a detection. At right are graphs showing the results of Cas12a detection as measured by fluorescence over time for each tested condition.

FIG. 42 depicts a flow chart and six line graphs. The flow chart shows three boxes labeled, from top to bottom, "DNA/RNA," "LAMP/RT-LAMP," and "Cas12a Detection." The six line graphs show fluorescence over time. In all six plots, the x-axis shows minutes from 0 to 75 in increments of 25, and the y-axis shows raw fluorescence (AU) from 0 to 60,000 in increments of 20,000. All six plots show three lines corresponding to different crRNAs. The three lines show on-target #1, on-target #2, and off-target. The upper left plot shows Primers=IAV1, Target=IAV. The line corresponding to on-target #2 rises over time and is the highest. The line corresponding to off-target rises slightly over time. The line corresponding to on-target #1 appear approximately flat. The upper middle plot shows Primers=IAV2, Target=IAV. The line corresponding to on-target #2 rises over time and is the highest. The line corresponding to on-target #1 rises over time, but is not as high as on-target #2. The line corresponding to off-target rises slightly over time and is the lowest. The upper right plot shows Primers=IAV3, Target=IAV. The line corresponding to on-target #1 rises over time and is the highest. The line corresponding to off-target rises slightly over time, but is not as high as on-target #1. The line corresponding to on-target #2 appear low on the graphs and appear approximately flat. The lower left plot shows Primers=IAV1, Target=NTC. The line corresponding to on-target #2 rises over time and is the highest. The line corresponding to off-target rises slightly over time, but is not as high as on-target #2. The line corresponding to on-target #1 appears approximately flat. The lower middle plot shows Primers=IAV2, Target=NTC. The line corresponding to off target rises slightly over time. The lines corresponding to on-target #1 and on-target #2 appear approximately flat. The lower right plot shows Primers=IAV3, Target=NTC. The line corresponding to off target rises slightly over time. The lines corresponding to on-target #1 and on-target #2 appear low on the graphs and look approximately flat.

Figure 43:
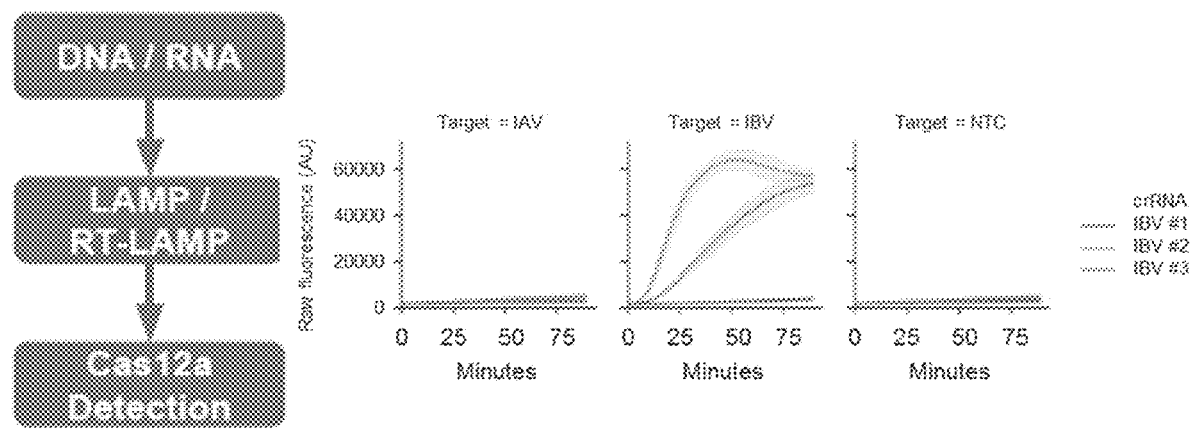
FIG. 43 shows the identification of optimal crRNAs for the specific detection of Influenza B (IBV) RT-LAMP amplicons. At left is a schematic of the workflow including providing DNA/RNA, LAMP/RT-LAMP, and Cas12a detection. At right are graphs showing the results of Cas12a detection as measured by fluorescence over time for each tested condition (IAV is influenza A virus, IBV is influenza B virus, NTC is no template control).

FIG. 43 depicts a flow chart and three line graphs. The flow chart shows three boxes labeled, from top to bottom, "DNA/RNA," "LAMP/RT-LAMP," and "Cas12a Detection." The three line graphs show fluorescence over time. In all three plots, the x-axis shows minutes from 0 to 75 in increments of 25, and the y-axis shows raw fluorescence (AU) from 0 to 60,000 in increments of 20,000. All three plots show three lines corresponding to different crRNAs. The three lines IBV #1, IBV #2, and IBV #3. The left plot shows Target=IAV. All three lines appear approximately flat. The middle plot shows Target=IBV. The line corresponding to IBV #3 rises over time and is the highest. The line corresponding to IBV #2 rises over time, but not as rapidly as IBV #3. The line corresponding to IBV #1 appears approximately flat. The right plot shows Target=NTC. All three lines appear approximately flat.

FIG. 45B shows six line graphs. In all six plots, the x-axis shows minutes from 0 to 75 in increments of 25, and the y-axis shows raw fluorescence (AU) from 0 to 60,000 in increments of 20,000. All six plots show two lines corresponding to concentrations of 10000 and 0. The upper left plot shows Target=IAV, crRNA=IAV. The line corresponding to 10000 rises over time and is the highest. The line corresponding to 0 appear approximately flat. The upper middle plot shows Target=IBV, crRNA=IAV. Neither line is visible. The upper right plot shows Target=IAV and IBV, crRNA=IAV. The line corresponding to 10000 rises over time and is the highest. The line corresponding to 0 appears approximately flat. The lower left plot shows Target=IAV, crRNA=IBV. Neither line is visible. The lower middle plot shows Target=IBV, crRNA=IBV. The line corresponding to 10000 rises over time and is the highest. The line corresponding to 0 appear approximately flat. The lower right plot shows Target=IAV and IBV, crRNA=IBV. The line corresponding to 10000 rises over time and is the highest. The line corresponding to 0 appears approximately flat.

Figure 46:
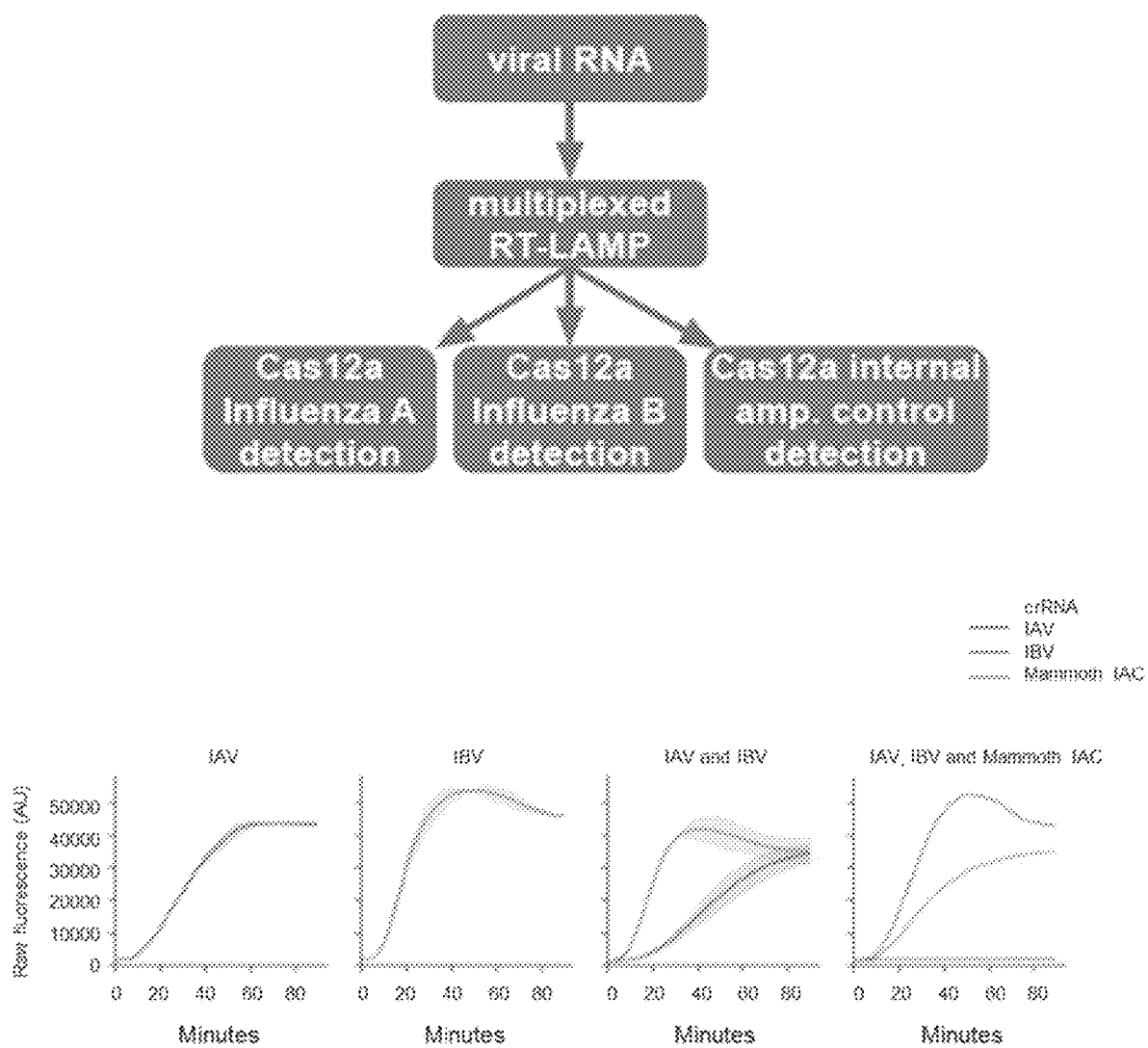
FIG. 46 shows Cas12a discrimination between a triple multiplexed RT-LAMP reaction for Influenza A, Influenza B, and the Mammuthus *primigenius* (Wooly Mammoth) mitochondria internal amplification control sequence after 30 minutes of multiplexed RT-LAMP amplification at 60° C. At top is a schematic of the workflow including providing viral RNA, multiplexed RT-LAMP, and Cas12a influenza A detection or Cas12a influenza B detection or Cas12 internal amplification control detection. At bottom are graphs showing the results of Cas12 detection as measured by fluorescence over time for each tested condition.

FIG. 46 depicts a flow chart and four line graphs. The flow chart has five boxes. The top box reads "viral RNA," the middle box reads "multiplexed RN-LAMP," and the remaining boxes read, from left to right, "Cas12 Influenza A detection," "Cas12 Influenza B detection," and "Cas12a internal amp. detection." The four plots depict fluorescence over time. The x-axis of all four plots shows minutes from 0 to 80 in increments of 20, and the y-axis shows raw fluorescence (AU) from 0 to 50,000 in increments of 10,000. Each plot shows three lines corresponding to different crRNAs, IAV, IBV, and Mammoth IAC. The left-most plot depicts IAV. The line corresponding to IAV rises over time. The second plot from the left shows IBV. The line corresponding to IBV rises over time. The second plot from the right depicts IAV and IBV. The line corresponding to IBV rises over time and is the highest. The line corresponding to IAV rises over time, but is not as high as IBV. The right-most plot depicts IAV, IBV, and Mammoth IAC. The line corresponding to IBV rises over time and is the highest. The line corresponding to Mammoth IAC rises over time, but is not as high as IBV. The line corresponding to IAV appears approximately flat.

Figure 50:
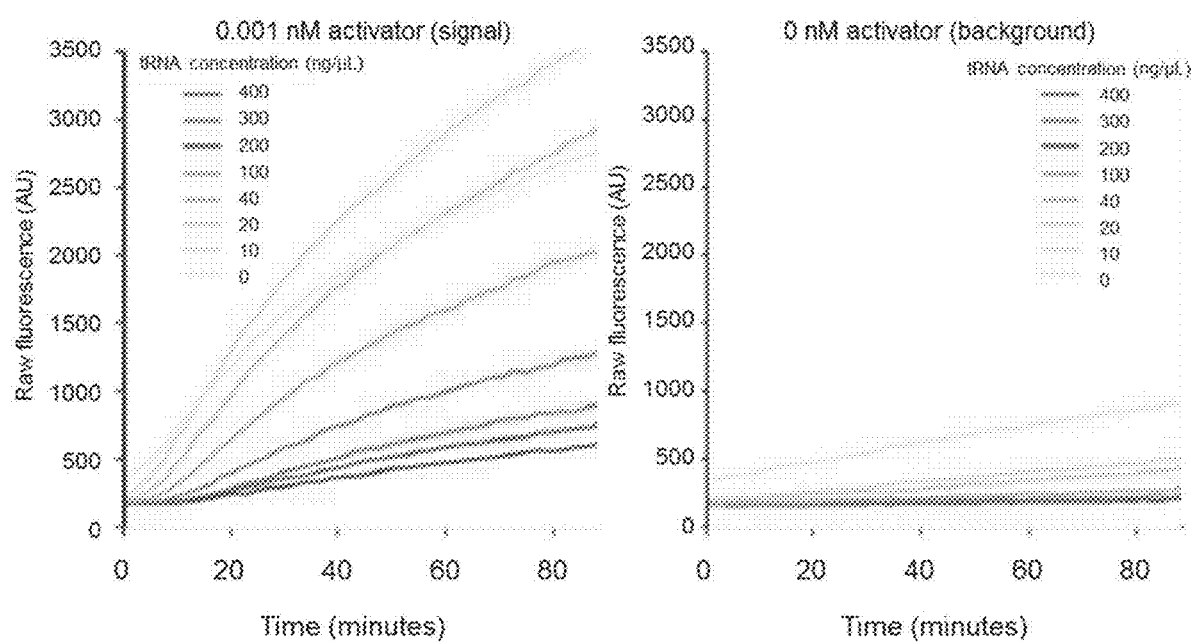
FIG. 50 shows graphs of activity, as measured by fluorescence, with (left graph) and without (right graph) activator over time.

FIG. 50 shows two line plots. Both plots show fluorescence over time. The x-axis of both plots shows time (minutes) from 0 to 80 in increments of 20, and the y-axis shows raw fluorescence (AU) from 0 to 3500 in increments of 500. Each plot depicts eight lines corresponding to eight different tRNA concentrations (nm/4) of 400, 300, 200, 100, 40, 20, 10 and 0, from darkest line to lightest line. The left plot depicts 0.001 nM activator (signal). All eight lines rise over time. The lines, from upper left to lower right, correspond to 10, 20, 0, 40, 100, 200, 300, and 400. The right plot depicts 0 nM activator (background). The lines corresponding to 0, 10, and 20 rise slightly over time, with 0 being the highest, followed by 10, and 20 being the lower of the three. The lines corresponding to 40, 100, 200, 300, and 400 appear approximately flat.

FIG. 51A shows two line plots. Both plots show fluorescence over time. The x-axis of both plots shows time (minutes) from 0 to 80 in increments of 20, and the y-axis shows raw fluorescence (AU) from 0 to 3500 in increments of 500. Each plot depicts eight lines corresponding to eight different Urea concentrations (mM) of 1400, 800, 600, 400, 300, 200, 50, from darkest line to lightest line, and 0. The left plot depicts 0.001 nM activator (signal). The lines corresponding 1400 and 800 appear approximately flat. The remaining lines rise slightly over time. In order of highest to lowest, the remaining lines correspond to 50, 0, 200, 300, 400, and 600. The right plot depicts 0 nM activator (background). All eight lines appear approximately flat.

FIG. 51B shows two line plots. Both plots show fluorescence over time. The x-axis of both plots shows time (minutes) from 0 to 80 in increments of 20, and the y-axis shows raw fluorescence (AU) from 0 to 3500 in increments of 500. Each plot depicts eight lines corresponding to eight different SDS concentrations (%) of 2.0, 1.2, 1.0, 0.8, 0.5, 0.2, 0.1, from darkest line to lightest line, and 0.0. The left plot depicts 0.001 nM activator (signal). The line corresponding to 0.0 rises over time. The lines corresponding to 2.0, 1.2, 1.0, 0.8, 0.5, 0.2, and 0.1 appear approximately flat. The right plot depicts 0 nM activator (background). All eight lines appear approximately flat.

FIG. 52A shows a bar graph depicting florescence at different salt concentrations. The x-axis shows NaCl, and the y-axis shows background subtracted fluorescence (AU) from 0 to 14,000 in increments of 2,000. The eight bars, from left to right, show salt conc (mM) of 0, 10, 20, 50, 60, 70, 80, and 120.

FIG. 52B shows a bar graph depicting florescence at different salt concentrations. The x-axis shows KCl, and the y-axis shows background subtracted fluorescence (AU) from 0 to 14,000 in increments of 2,000. The eight bars, from left to right, show salt conc (mM) of 0, 10, 20, 50, 60, 70, 80, and 120.

FIG. 53A shows a bar graph depicting florescence at different DTT concentrations. The x-axis shows NaCl-DTT, and the y-axis shows background subtracted fluorescence (AU) from 0 to 16,000 in increments of 2,000. The seven bars, from left to right, show DTT conc (mM) of 0, 0.1, 1.0, 2.0, 3.0, 4.0, and 10.0.

FIG. 53B shows a bar graph depicting florescence at different DTT concentrations. The x-axis shows KCl-DTT, and the y-axis shows background subtracted fluorescence (AU) from 0 to 16,000 in increments of 2,000. The seven bars, from left to right, show DTT conc (mM) of 0, 0.1, 1.0, 2.0, 3.0, 4.0, and 10.0.

Figure 54:
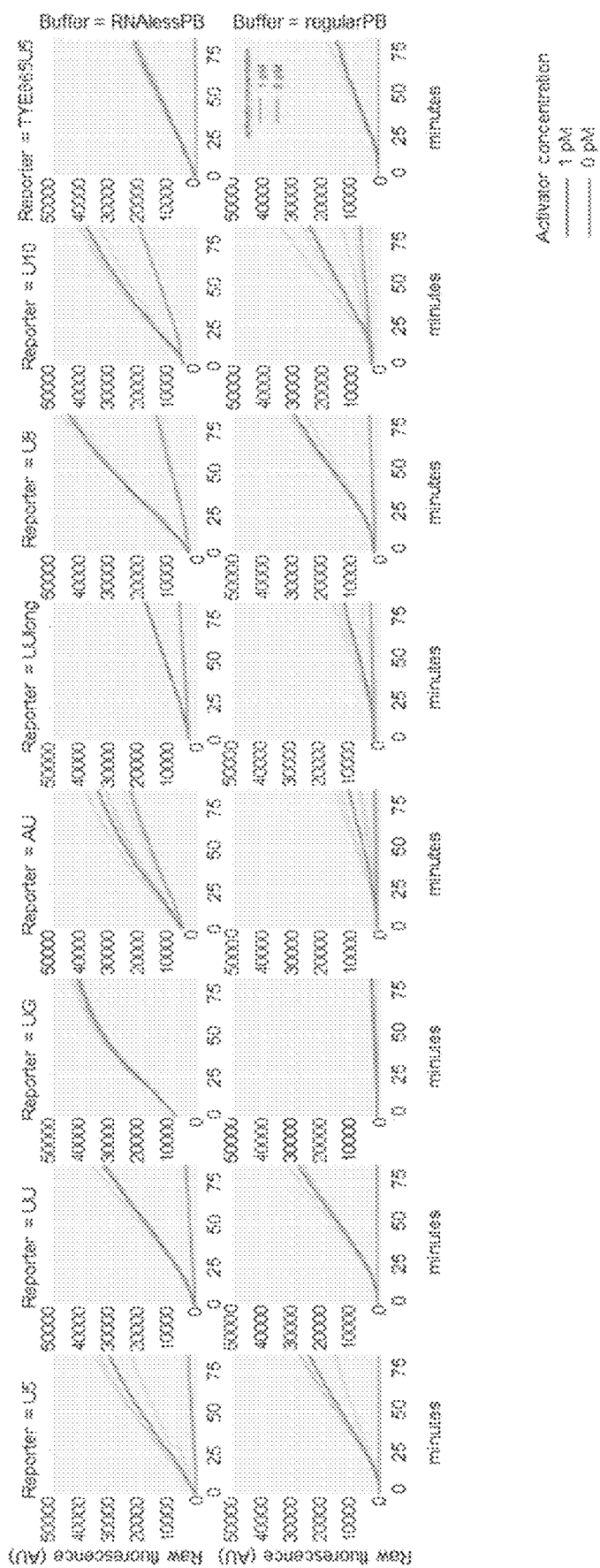
FIG. 54 shows the activity of Cas13a in the DETECTR assay, as measured by fluorescence, for each of the tested reporters.

FIG. 54 shows 16 line plots. All 16 plots show fluorescence over time. The x-axis of all 16 plots shows minutes from 0 to 75 in increments of 25, and the y-axis shows raw fluorescence (AU) from 0 to 50,000 in increments of 10,000. Each plot shows two lines corresponding to activator concentrations of 1 pM or 0 pM. The plots in the top row show different reporters with Buffer=RNAlessPB. The arrangement of the lines in each plot in the top row, from left to right, are as follows: In the plot showing Reporter=U5, the line corresponding to 1 pM rises over time, and the line corresponding to 0 pM appears approximately flat. In the plot showing Reporter=UU, the line corresponding to 1 pM rises over time, and the line corresponding to 0 pM appears approximately flat. In the plot showing Reporter=UG, the line corresponding to 1 pM rises over time, and the line corresponding to 0 pM rises over time and substantially overlaps the line corresponding to 1 pM. In the plot showing Reporter=AU, the line corresponding to 1 pM rises over time, and the line corresponding to 0 pM rises over time but remains lower than the line corresponding to 1 pM. In the plot showing Reporter=UUlong, the line corresponding to 1 pM rises slightly over time, and the line corresponding to 0 pM appears approximately flat. In the plot showing Reporter=U8, the line corresponding to 1 pM rises over time, and the line corresponding to 0 pM rises slightly over time but remains lower than the line corresponding to 1 pM. In the plot showing Reporter=U10, the line corresponding to 1 pM rises over time, and the line corresponding to 0 pM rises over time but remains lower than the line corresponding to 1 pM. In the plot showing Reporter=TYE665U5, the line corresponding to 1 pM rises over time, and the line corresponding to 0 pM appears approximately flat. The plots in the bottom row show different reporters with Buffer=regularPB. The arrangement of the lines in each plot in the bottom row, from left to right, are as follows: In the plot showing Reporter=U5, the line corresponding to 1 pM rises over time, and the line corresponding to 0 pM appears approximately flat. In the plot showing Reporter=UU, the line corresponding to 1 pM rises over time, and the line corresponding to 0 pM appears approximately flat. In the plot showing Reporter=UG, both lines appear approximately flat. In the plot showing Reporter=AU, the line corresponding to 1 pM rises slightly over time, and the line corresponding to 0 pM appears approximately flat. In the plot showing Reporter=UUlong, the line corresponding to 1 pM rises slightly over time, and the line corresponding to 0 pM appears approximately flat. In the plot showing Reporter=U8, the line corresponding to 1 pM rises over time, and the line corresponding to 0 pM appears approximately flat. In the plot showing Reporter=U10, the line corresponding to 1 pM rises over time, and the line corresponding to 0 pM appears approximately flat. In the plot showing Reporter=TYE665U5, the line corresponding to 1 pM rises over time, and the line corresponding to 0 pM appears approximately flat.

Figure 55:
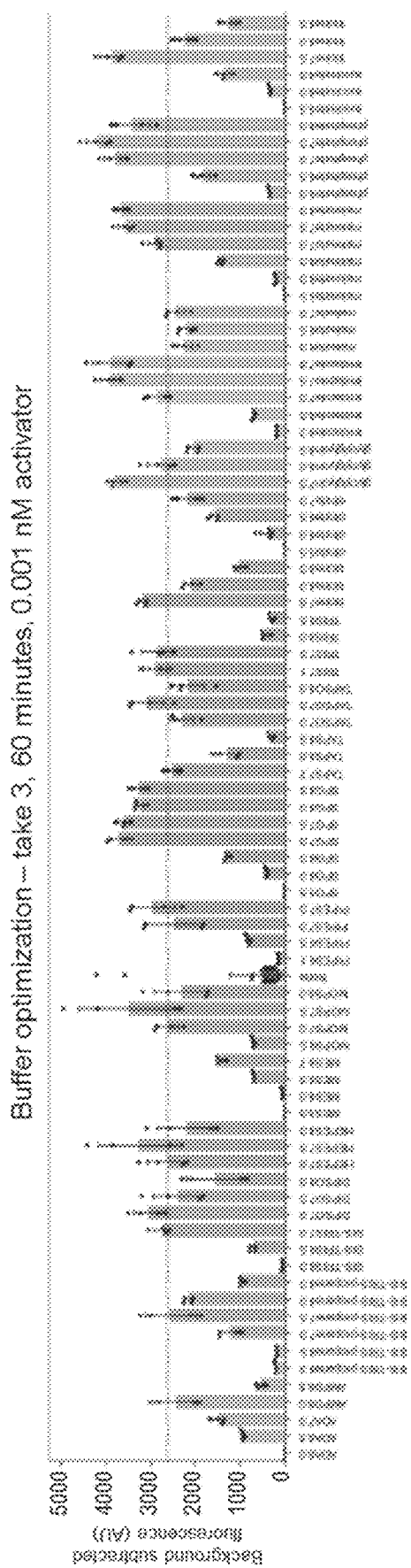
FIG. 55 shows Cas13a activity in the DETECTR assay, as measured by fluorescence, for each of the tested conditions.

FIG. 55 shows a bar graph of buffer optimization—take 3, 60 minutes, 0.001 nM activator. The y-axis shows background subtracted fluorescence (AU) from 0 to 5000 in increments of 1000. The bars labeled on the x-axis correspond to, from left to right: ADA6.0, ADA6.5, ADA7.0, AMPD8.0, AMPD8.5, BIS-TRIS-propane 6.3, BIS-TRIS-propane 6.5, BIS-TRIS-propane 7.0, BIS-TRIS-propane 7.5, BIS-TRIS-propane 8.0, BIS-TRIS-propane 8.5, BIS-TRIS 6.0, BIS-TRIS 6.5, BIS-TRIS 7.0, DIPSO7.0, DIPSO7.5, DIPSO8.0, HEPES7.0, HEPES7.5, HEPES8.0, MES5.5, MES6.0, MES6.5, MES6.7, MOPS6.5, MOPS7.0, MOPS7.5, MOPS8.0, Nono, PIPES6.1, PIPES6.5, PIPES7.0, PIPES7.5, SPG5.5, SPG6.0, SPG6.5, SPG7.0, SPG7.5, SPG8.0, SPG8.5, TAPS7.7, TAPS8.0, TAPS8.5, TAPSO 7.0, TAPSO 7.5, TAPSO 8.0, TRIS 7.1, TRIS 7.5, TRIS 8.0, TRIS 8.5, bioine 7.6, bioine 8.0, bioine 8.5, otrate 5.5, otrate 6.0, otrate 6.5, otrate 7.0, glycylglycin 7.5, glycylglycin 8.0, glycylglycin 8.5, midazole 6.2, midazole 6.5, midazole 7.0, midazole 7.5, midazole 7.8, malsate 6.0, malsate 6.5, malsate 7.0, melonate 5.5, melonate 6.0, melonate 6.5, melonate 7.0, melonate 7.5, melonate 8.0, phosphate 6.0, phosphate 6.5, phosphate 7.0, phosphate 7.5, phosphate 8.0, succinate 5.5, succinate 6.0, succinate 6.5, tricine 7.5, tricine 8.0, and tricine 8.5.

Figure 56:
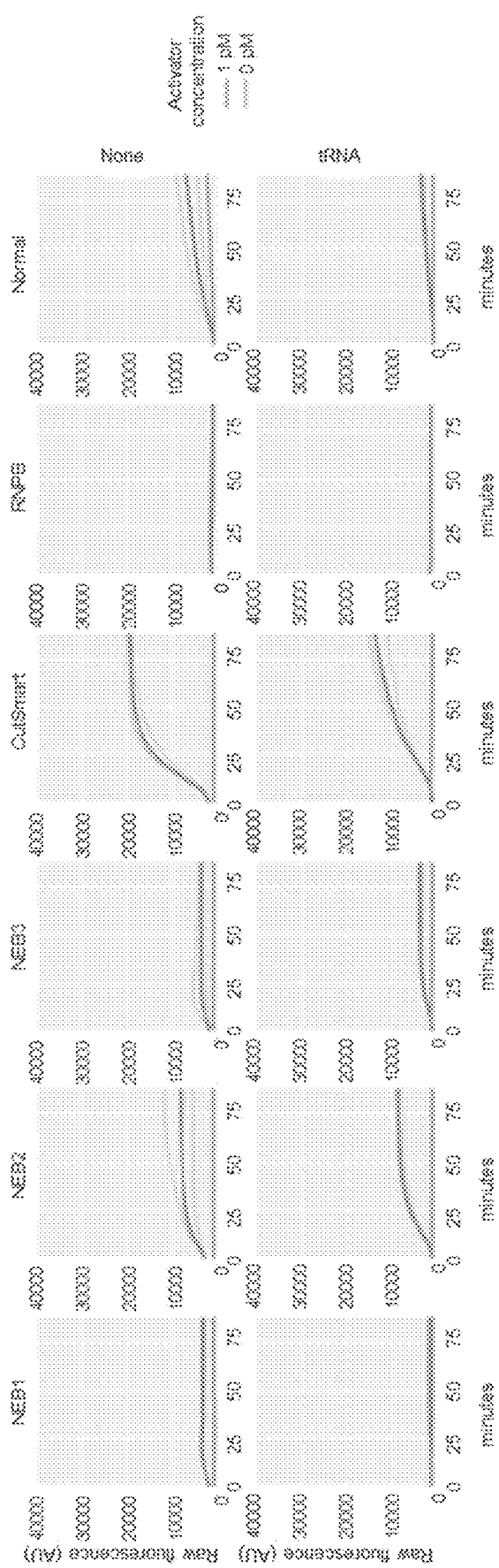
FIG. 56 shows Cas13a performance in the DETECTR assay, as measured by fluorescence, for each of the five commercially available buffers and the original HEPES pH 6.8 buffer.

FIG. 56 shows 12 line plots. All 12 plots show fluorescence over time. The x-axis of all 16 plots shows minutes from 0 to 75 in increments of 25, and the y-axis shows raw fluorescence (AU) from 0 to 40,000 in increments of 10,000. Each plot shows two lines corresponding to activator concentrations of 1 pM or 0 pM. The plots in the top row show different buffers with no tRNA. The arrangement of the lines in each plot in the top row, from left to right, are as follows: In the plot showing NEB1, the line corresponding to 1 pM rises very slightly over time, and the line corresponding to 0 pM appears approximately flat. In the plot showing NEB2, the line corresponding to 1 pM rises slightly over time, and the line corresponding to 0 pM appears approximately flat. In the plot showing NEB3, the line corresponding to 1 pM rises very slightly over time, and the line corresponding to 0 pM appears approximately flat. In the plot showing CutSmart, the line corresponding to 1 pM rises over time, and the line corresponding to 0 pM appears approximately flat. In the plot showing RNPB, both lines appear approximately flat. In the plot showing Normal, the line corresponding to 1 pM rises slightly over time, and the line corresponding to 0 pM rises slightly over time but remains below the line corresponding to 1 pM. The plots in the bottom row show different buffers with tRNA. The arrangement of the lines in each plot in the bottom row, from left to right, are as follows: In the plot showing NEB1, both lines appear approximately flat. In the plot showing NEB2, the line corresponding to 1 pM rises slightly over time, and the line corresponding to 0 pM appears approximately flat. In the plot showing NEB3, the line corresponding to 1 pM rises very slightly over time, and the line corresponding to 0 pM appears approximately flat. In the plot showing CutSmart, the line corresponding to 1 pM rises over time, and the line corresponding to 0 pM appears approximately flat. In the plot showing RNPB, both lines appears approximately flat. In the plot showing Normal, the line corresponding to 1 pM rises slightly over time, and the line corresponding to 0 pM rises slightly over time but remains below the line corresponding to 1 pM.

Figure 57:
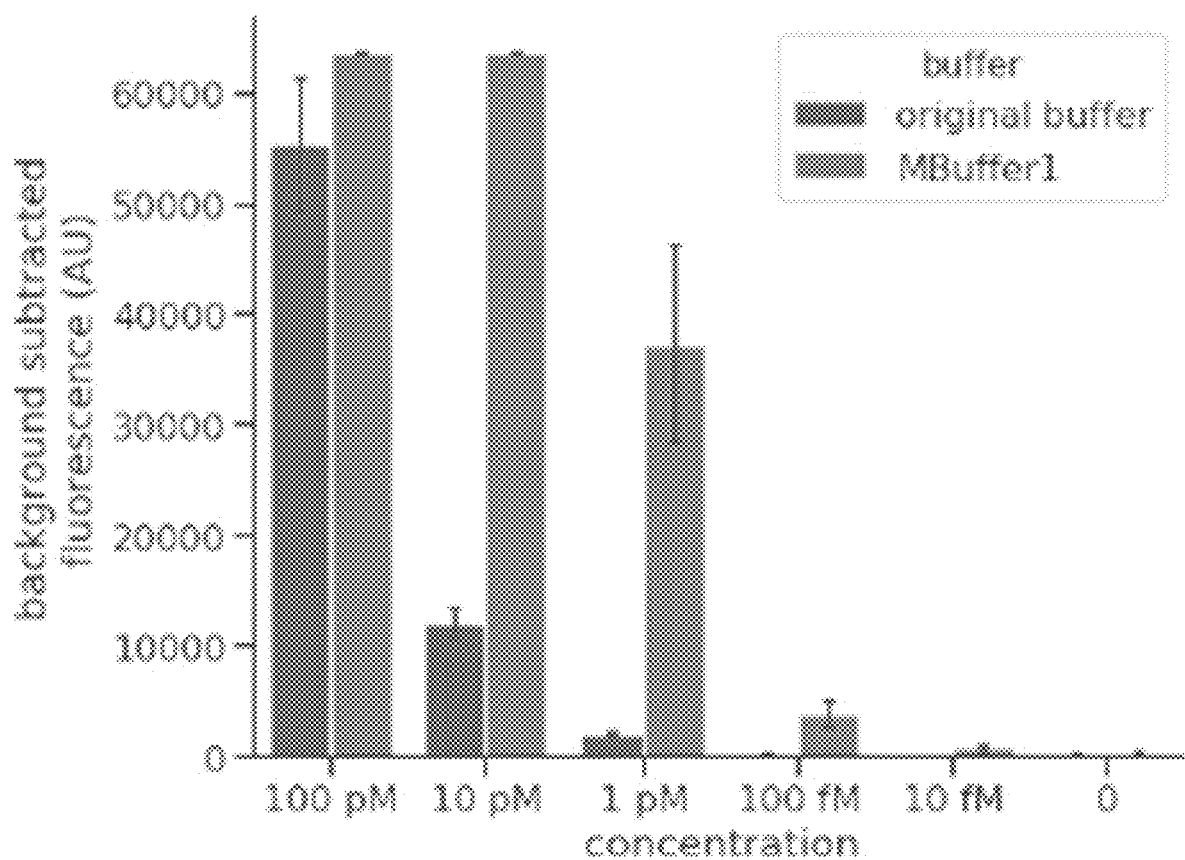
FIG. 57 shows a head-to-head comparison of the original HEPES pH 6.8 buffer to the optimized MBuffer1 for a Cas13a DETECTR assay with serially diluted target RNAs and run at 37° C. for 30 minutes.

FIG. 57 shows a bar plot depicting fluorescence at different concentrations. The y-axis shows background subtracted fluorescence from 0 to 60,000 in increments of 10,000. The bar plot shows six sets of two bars. The six sets correspond to, from left to right, 100 pM, 10 pM, 1 pM, 100 fM, 10 fM, and 0. Each set of two bars shows original buffer on the left and MBuffer 1 on the right. At 100 pM, the MBuffer1 bar is slightly higher than the original buffer bar. At 10 pM and 1 pM, the MBuffer1 bar is much higher than the original buffer bar. The original buffer bar is not visible at 100 fM, 10 fM or 0. The MBuffer1 bar is not visible at 0.

Figure 60:
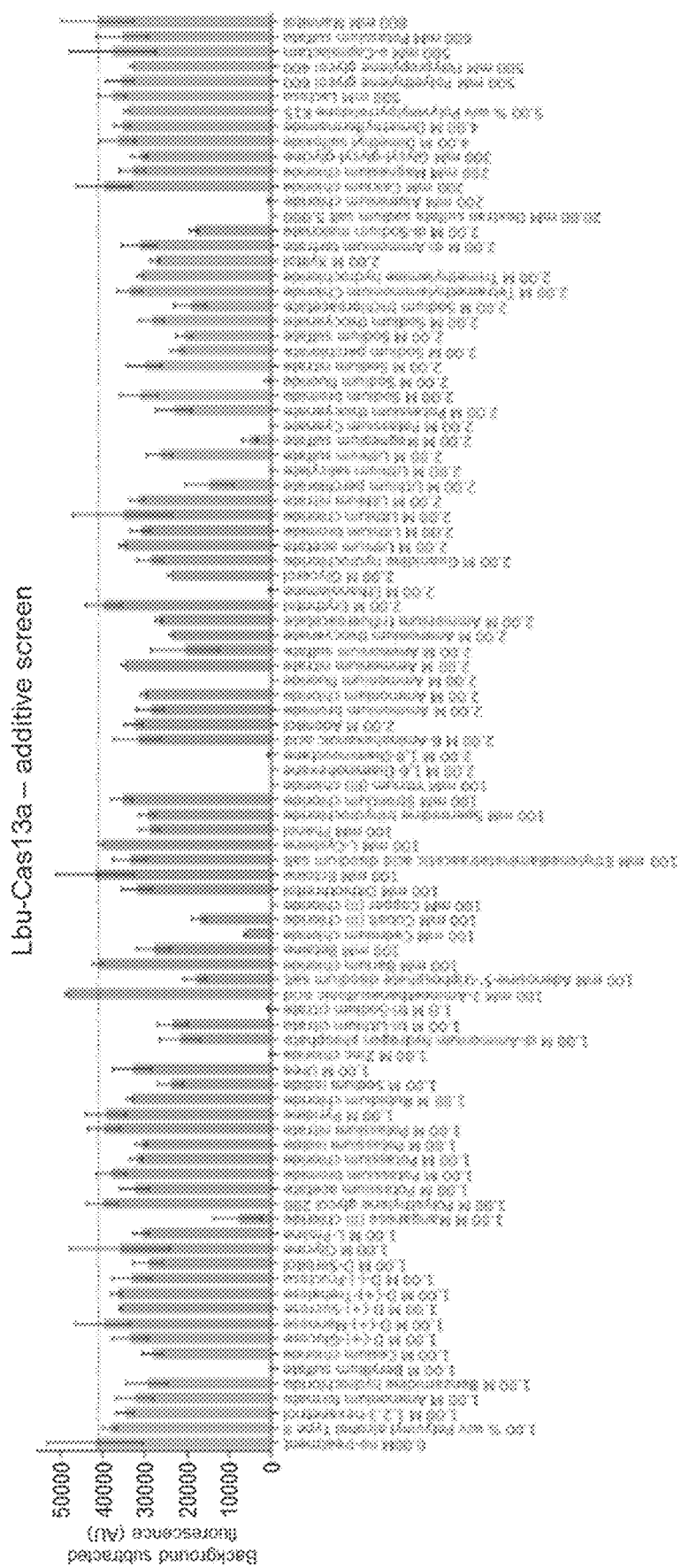
FIG. 60 shows Cas13a performance in DETECTR assays, as measured by fluorescence, versus the different additives tested.

FIG. 60 shows a bar graph of Lbu-Cas13a—additive screen. The y-axis shows background subtracted fluorescence (AU) from 0 to 50,000 in increments of 10,000. The bars labeled on the x-axis correspond to, from left to right: 0.00 M no-treatment, 1.00% w/v Polyvinyl alcohol Type III, 1.00 M 1,2,3 hexemetriol, 1.00 M Ammonium formate, 1.00 M Benzamidine hydrochloride, 1.00 M Beryllium sulfate, 1.00 M Cesium chloride, 1.00 M D-*(+I-Glucose, 1.00 M D-(+1-Marinose, 1.00 M D-(+1-Sucrose, 1.00 M D-(+-Trehalose, 1.00 M D-I-1-Fructose, 1.00 M D-Sorbitol, 1.00 M Glycine, 1.00 M L-Proline, 1.00 M Manganese (II) chloride, 1.00 M Polyethylene glycol 200, 1.00 M Potassium acetate, 1.00 M Potassium bromide, 1.00 M Potassium chloride, 1.00 M Potassium iodide, 1.00 M Potassium nitrate, 1.00 M Pyridine, 1.00 M Rubidium chloride, 1.00 M Sodium iodide, 1.00 M Urea, 1.00 M Zinc chloride, 1.00 M di-Ammonium hydrogen phosphate, 1.00 M tri-Lithium citrate, 1.8 M tri-Sodium citrate, 100 mM 2-Aminceathane-sulfonic acid, 100 mM Adenosine-5'-triphosphate disodium salt, 100 mM Barium chloride, 100 mM Betaine, 100 mM Cadmium chloride, 100 mM Cobalt (II) chloride, 100 mM Cooper (II) chloride, 100 mM Dithiothreitol, 100 mM Ectoine, 100 mM Ethylenediaminetetraacetic acid disodium salt, 100 mM L-Cysteine, 100 mM Phenol, 100 mM Spermidine trihydrochloride, 100 mM Strontium chloride, 100 mM Yttrium (III) chloride, 2.00 M 1,6-Diaminohexane, 2.00 M 1,8-Diaminooctane, 2.00 M 6-Aminohexanoic acid, 2.00 M Adonitol, 2.00 M Ammonium bromide, 2.00 M Ammonium chloride, 2.00 M Ammonium fluoride, 2.00 M Ammonium nitrate, 2.00 M Ammonium sulfate, 2.00 M Ammonium thiocyanate, 2.00 M Ammonium trifluoroacetate, 2.00 M Erythritol, 2.00 M Ethanolamine, 2.00 M Glycerol, 2.00 M Guanidine hydrochloride, 2.00 M Lithium acetate, 2.00 M Lithium bromide, 2.00 M Lithium chloride, 2.00 M Lithium nitrite, 2.00 M Lithium perchlorate, 2.00 M Lithium salicylate, 2.00 M Lithium sulfate, 2.00 M Magnesium sulfate, 2.00 M Potassium Cyanate, 2.00 M Potassium thiocyanate, 2.00 M Sodium bromide, 2.00 M Sodium fluoride, 2.00 M Sodium nitrate, 2.00 M Sodium perchlorate, 2.00 M Sodium sulfate, 2.00 N Sodium thiocynate, 2.00 M Sodium trichloroacetate, 2.00 M Tetramethylammonium Chloride, 2.00 M Trimethylamine hydrochloride, 2.00 M Xylitol, 2.00 M di-Ammonium tartrate, 2.00 M di-Sodium malonate, 20.00 mM Dextran sulfate sodium salt 5,000, 200 mM Aluminum chloride, 200 mM Calcium chloride, 200 mM Magnesium chloride, 300 mM Glycyl-glycyl-glycine, 4.00 M Dimethyl sulfoxide, 4.00 M Dimethylformamide, 5.00%. w/v Polyvinylpyrrolidone K15, 500 mM Lactose, 500 mM Polyethylene glycol 600, 500 mM Polypropylene glycol 400, 500 mM e-Caprolactam, 600 mM Potassium sulfate, and 800 mM Mannitol.

Figure 61:
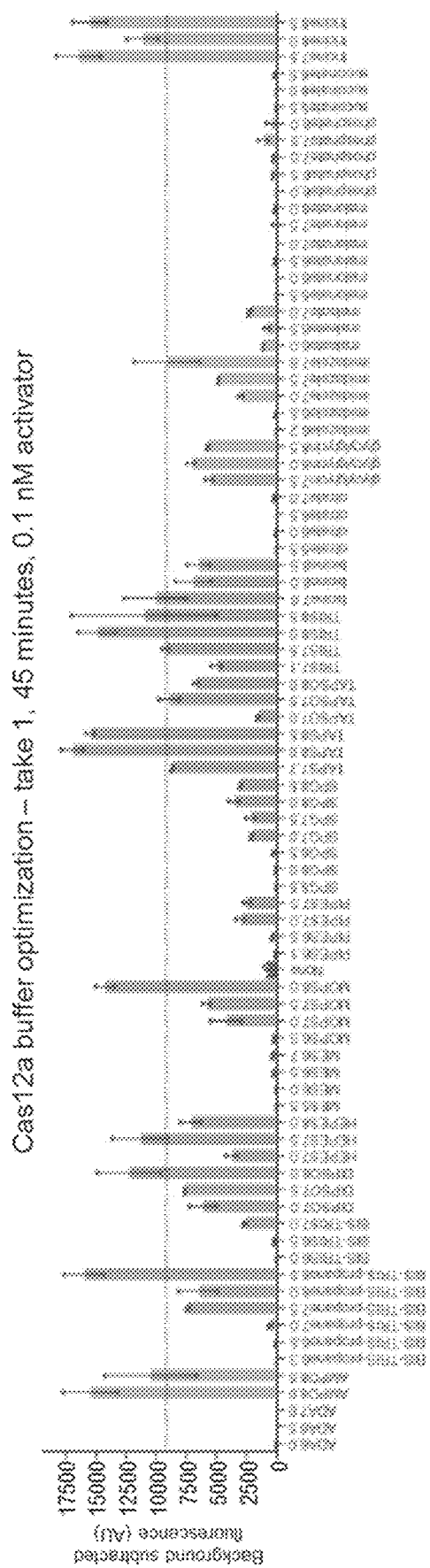
FIG. 61 shows the results of screening 84 different buffer and pH combinations to determine the optimal buffer for Lba-Cas12a activity in DETECTR assays, as measured by fluorescence.

FIG. 61 shows a bar graph of Cas12a buffer optimization—take 1, 45 minutes, 0.1 nM activator. The y-axis shows background subtracted fluorescence (AU) from 0 to 17500 in increments of 2500. The bars labeled on the x-axis correspond to, from left to right: ADA6.0, ADA6.5, ADA7.0, AMPD8.0, AMPD8.5, BIS-TRIS-propane 6.3, BIS-TRIS-propane 6.5, BIS-TRIS-propane 7.0, BIS-TRIS-propane 7.5, BIS-TRIS-propane 8.0, BIS-TRIS-propane 8.5, BIS-TRIS 6.0, BIS-TRIS 6.5, BIS-TRIS 7.0, DIPSO7.0, DIPSO7.5, DIPSO8.0, HEPES7.0, HEPES7.5, HEPES8.0, MES5.5, MES6.0, MES6.5, MES6.7, MOPS6.5, MOPS7.0, MOPS7.5, MOPS8.0, Nono, PIPES6.1, PIPES6.5, PIPES7.0, PIPES7.5, SPG5.5, SPG6.0, SPG6.5, SPG7.0, SPG7.5, SPG8.0, SPG8.5, TAPS7.7, TAPS8.0, TAPS8.5, TAPSO 7.0, TAPSO 7.5, TAPSO 8.0, TRIS 7.1, TRIS 7.5, TRIS 8.0, TRIS 8.5, bioine 7.6, bioine 8.0, bioine 8.5, otrate 5.5, otrate 6.0, otrate 6.5, otrate 7.0, glycylglycin 7.5, glycylglycin 8.0, glycylglycin 8.5, midazole 6.2, midazole 6.5, midazole 7.0, midazole 7.5, midazole 7.8, malsate 6.0, malsate 6.5, malsate 7.0, melonate 5.5, melonate 6.0, melonate 6.5, melonate 7.0, melonate 7.5, melonate 8.0, phosphate 6.0, phosphate 6.5, phosphate 7.0, phosphate 7.5, phosphate 8.0, succinate 5.5, succinate 6.0, succinate 6.5, tricine 7.5, tricine 8.0, and tricine 8.5.

Figure 62:
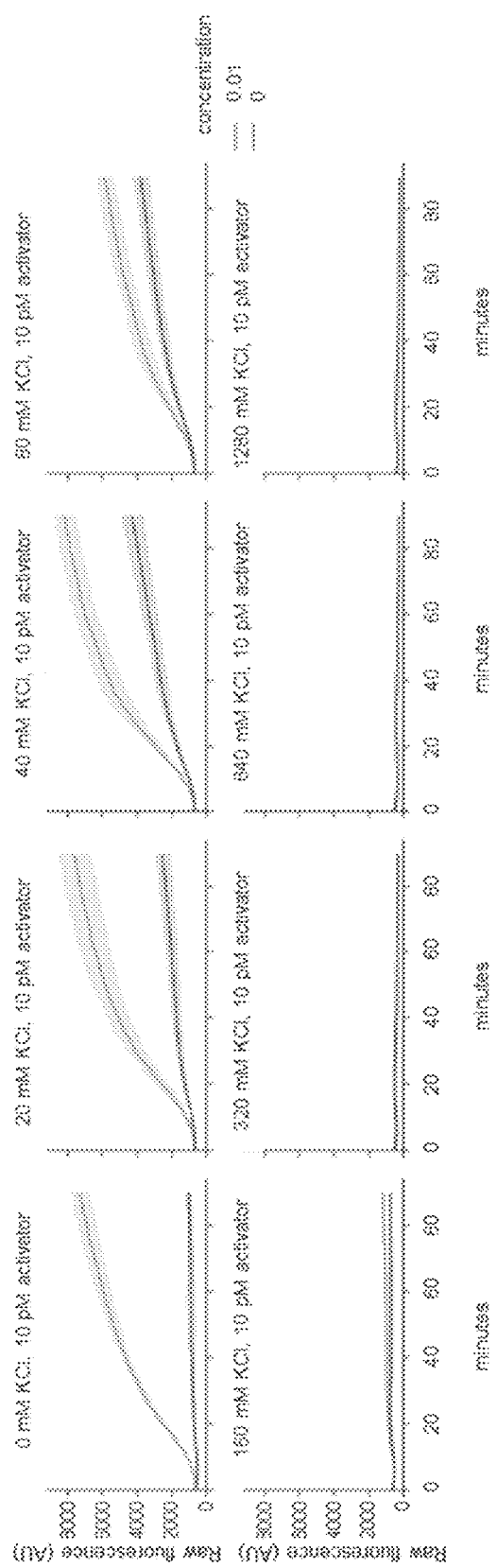
FIG. 62 shows Lba-Cas12a performance in DETECTR assays, as measured by fluorescence, in each of the tested conditions.

FIG. 62 shows eight line plots. All eight plots show fluorescence over time. The x-axis of all eight plots shows minutes from 0 to 80 in increments of 20, and the y-axis shows raw fluorescence (AU) from 0 to 5000 in increments of 1000. Each plot shows two lines corresponding to concentrations of 0.01 or 0. The arrangement of the lines in each plot in the top row, from left to right, are as follows: In the plot showing 0 mM KCl, 10 pM activator, the line corresponding to 0.01 rises over time, and the line corresponding to 0 appears approximately flat. In the plot showing 20 mM KCl, 10 pM activator, the line corresponding to 0.01 rises over time, and the line corresponding to 0 rises slightly over time but remains lower than the line corresponding to 0.01. In the plot showing 40 mM KCl, 10 pM activator, the line corresponding to 0.01 rises over time, and the line corresponding to 0 rises slightly over time but remains lower than the line corresponding to 0.01. In the plot showing 80 mM KCl, 10 pM activator, the line corresponding to 0.01 rises over time, and the line corresponding to 0 slightly over time but remains lower than the line corresponding to 0.01. In the plot showing 160 mM KCl, 10 pM activator, both lines appear approximately flat. In the plot showing 320 mM KCl, 10 pM activator, both lines appear approximately flat. In the plot showing 640 mM KCl, 10 pM activator, both lines appear approximately flat. In the plot showing 1280 mM KCl, 10 pM activator, both lines appear approximately flat.

Figure 63:
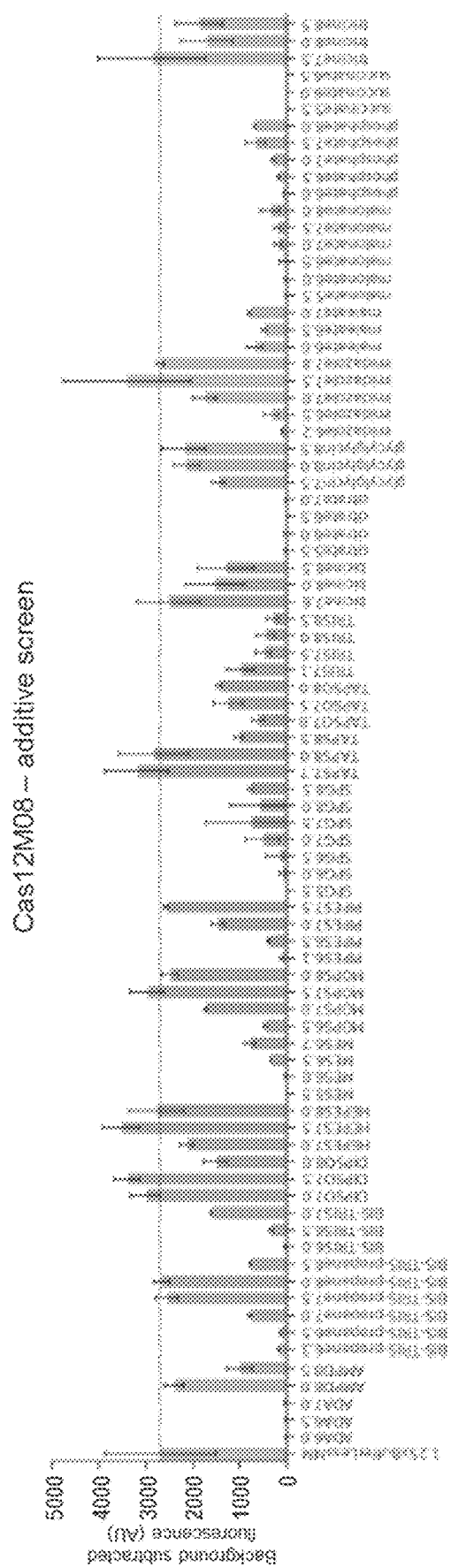
FIG. 63 shows Cas12M08 performance in DETECTR assays, as measured by fluorescence, for each of the tested conditions (buffer type and pH).

FIG. 63 shows a bar graph of Cas12M08—additive screen. The y-axis shows background subtracted fluorescence (AU) from 0 to 5000 in increments of 1000. The bars labeled on the x-axis correspond to, from left to right: 1.25× BufferLessMM, ADA6.0, ADA6.5, ADA7.0, AMPD8.0, AMPD8.5, BIS-TRIS-propane 6.3, BIS-TRIS-propane 6.5, BIS-TRIS-propane 7.0, BIS-TRIS-propane 7.5, BIS-TRIS-propane 8.0, BIS-TRIS-propane 8.5, BIS-TRIS 6.0, BIS-TRIS 6.5, BIS-TRIS 7.0, CIPSO7.0, CIPSO7.5, CIPSO8.0, HEPES7.0, HEPES7 5, HEPES8.0, MES5.5, MES6.0, MES6.5, MES6.7, MOPS6.5, MOPS7.0, MOPS7.5, MOPS8.0, PIPES6.1, PIPES6.5, PIPES7.0, PIPES7.5, SPG5.5, SPG6.0, SPG6.5, SPG7.0, SPG7.5, SPG8.0, SPG8.5, TAPS7.7, TAPS8.0, TAPS8.5, TAPSO 7.0, TAPSO 7.5, TAPSO 8.0, TRIS 7.1, TRIS 7.5, TRIS 8 0, TRIS 8.5, bicine 7.0, bicine 8.0, bicine 8.5, citrate 5.5, citrate 6.0, citrate 6.5, citrate 7.0, glycylglycine 7.5, glycylglycine 8.0, glycylglycine 8.5, irridazole 6.2, irridazole 6.5, irridazole 7.0, irridazole 7.5, irridazole 7.8, maleate 6.0, maleate 6.5, maleate 7.0, malonate 5.5, malonate 6.0, malonate 6.5, malonate 7.0, malonate 7.5, malonate 8.0, phosphate 6.0, phosphate 6.5, phosphate 7.0, phosphate 7.5, phosphate 8.0, succinate 5.5, succinate 6.0, succinate 6.5, tricine 7.5, tricine 8.0, and tricine 8.5.

Figure 64:
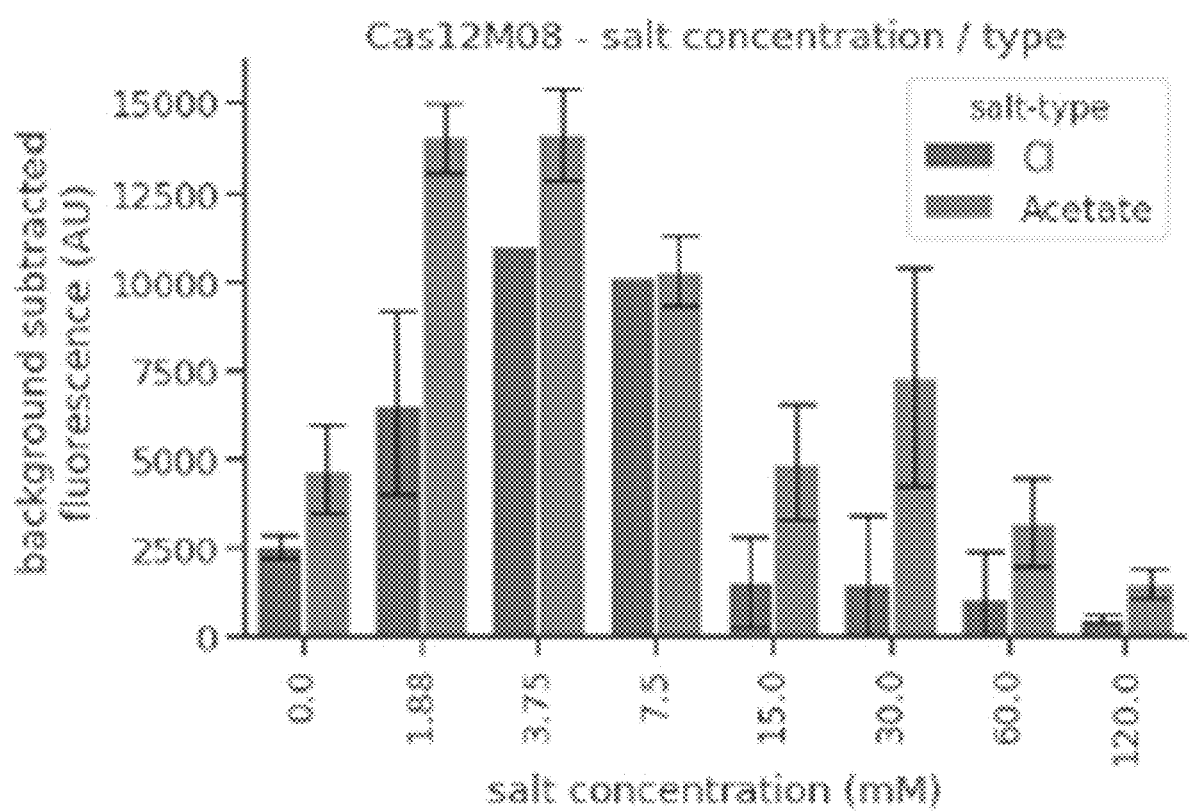
FIG. 64 shows Cas12M08 performance in DETECTR assays, as measured by fluorescence, for the various salt types and concentrations tested.

FIG. 64 shows a bar plot depicting fluorescence at different salt types and concentrations. The y-axis shows background subtracted fluorescence from 0 to 15,000 in increments of 2,500. The bar plot shows eight sets of two bars. The eight sets correspond to salt concentrations (mM) of, from left to right, 0.0, 1.88, 3.75, 7.5, 15.0, 30.0, 60.0, and 120.0. Each set of two bars shows Cl on the left and Acetate.

Figure 66:
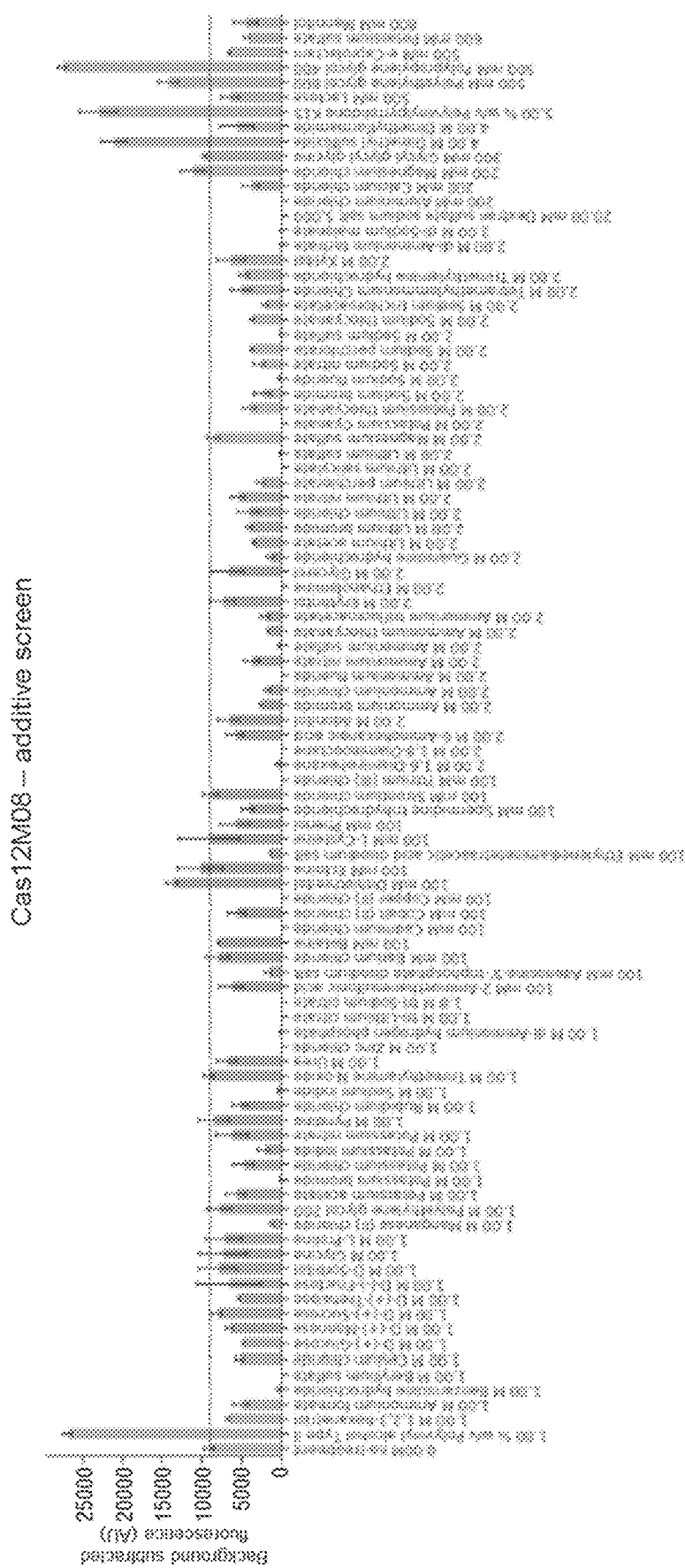
FIG. 66 shows that specific compounds inhibited the performance of the assay including: benzamidine hydrochloride, beryllium sulfate, manganese chloride, potassium bromide, sodium iodine, zinc chloride, di-ammonium hydrogen phosphate, tri-lithium citrate, tri-sodium citrate, cadmium chloride, copper chloride, yttrium chloride, 1-6 diaminohexane, 1-8-diaminooctane, ammonium fluoride, and ammonium sulfate.

FIG. 66 shows a bar graph of Cas12M08—additive screen. The y-axis shows background subtracted fluorescence (AU) from 0 to 25,000 in increments of 5,000. The bars labeled on the x-axis correspond to, from left to right: 0.00M no-treatment, 1.00% w/v Polyvinyl alcohol Type II, 1.00 M 1,2,3-hexanetriol, 1.00 M Ammonium formate, 1.00 M Benzamidine hydrochloride, 1.00 M Beryllium sulfate, 1.00 M Cesium chloride, 1.00 M D-(+)-Glucose, 1.00 M D-(+)-Mannose, 1.00 M D-(+)-Sucrose, 1.00 M D-(+)-Trehalose, 1.00 M D-(−)-Fructose, 1.00 M D-Sorbitol, 1.00 M Glycine, 1.00 M L-Proline, 1.00 M Manganese (II) chloride, 1.00 M Polyethylene glycol 200, 1.00 M Potassium acetate, 1.00 M Potassium bromide, 1.00 M Potassium chloride, 1.00 M Potassium iodide, 1.00 M Potassium nitrate, 1.00 M Pyridine, 1.00 M Rubidium chloride, 1.00 M Sodium iodide, 1.00 M Trimethylamine N-oxide, 1.00 M Urea, 1.00 M Zinc chloride, 1.00 M di-Ammonium hydrogen phosphate, 1.00 M tri-Lithium citrate, 1.8 M tri-Sodium citrate, 100 mM 2-Aminoethanesulfonic acid, 100 mM Adonosine-5'-triphosphate disodium salt, 100 mM Barium chloride, 100 mM Betaine, 100 mM Cadmium chloride, 100 mM Cobalt (II) chloride, 100 mM Copper (II) chloride, 100 mM Dithiothreitol, 100 mM Ectoine, 100 mM Ethylenediaminetetraacetic acid disodium salt, 100 mM L-Cysteine, 100 mM Phenol, 100 mM Spermidine trihydrochloride, 100 mM Strontium chloride, 100 mM Yttrium (III) chloride, 2.00 M 1,6-Diaminohexane, 2.00 M 1,8-Diaminooctane, 2.00 M 6-Aminohexanoic acid, 2.00 M Adonitol, 2.00 M Ammonium bromide, 2.00 M Ammonium chloride, 2.00 M Ammonium fluoride, 2.00 M Ammonium nitrate, 2.00 M Ammonium sulfate, 2.00 M Ammonium thiocyanate, 2.00 M Ammonium trifluoroacetate, 2.00 M Erythritol, 2.00 M Ethanolamine, 2.00 M Glycerol, 2.00 M Guanidine hydrochloride, 2.00 M Lithium acetate, 2.00 M Lithium bromide, 2.00 M Lithium chloride, 2.00 M Lithium nitrate, 2.00 M Lithium perchlorate, 2.00 M Lithium salicylate, 2.00 M Lithium sulfate, 2.00 M Magnesium sulfate, 2.00 M Potassium Cyanate, 2.00 M Potassium thiocyanate, 2.00 M Sodium bromide, 2.00 M Sodium fluoride, 2.00 M Sodium nitrate, 2.00 M Sodium perchlorate, 2.00 M Sodium sulfate, 2.00 M Sodium thiocyanate, 2.00 M Sodium trichloroacetate, 2.00 M Tetramethylammonium Chloride, 2.00 M Trimethylamine hydrochloride, 2.00 M Xylitol, 2.00 M di-Ammonium tartrate, 2.00 M di-Sodium malonate, 20.00 mM Dextran sulfate sodium salt 5,000, 200 mM Aluminium chloride, 200 mM Calcium chloride, 200 mM Magnesium chloride, 300 mM Glycyl-glycyl-glycine, 4.00 M Dimethyl sulfoxide, 4.00 M Dimethylformamidele, 5.00% w/v Polyvinylpyrrolidone K15, 500 mM Lactose, 500 mM Polyethylene glycol 600, 500 mM Polypropylene glycol 400, 500 mM e-Caprolactarn, 600 mM Potassium sulfate, and 800 mM Mannitol.

FIG. 93C shows six line plots depicting fluorescence over time. In all six plots the x-axis shows minutes from 0 to 75 in increments of 25, and the y-axis shows normalized fluorescence from 0.0 to 1.0 in increments of 0.2. Each plot depicts two sets of four lines. The first set of four lines shows concentrations (nM) of 2.5, 0.25, 0.025, and 0 with an RNA-FQ reporter (solid lines). The second set of four lines shows concentrations (nM) of 2.5, 0.25, 0.025, and 0 with an DNA-FQ reporter (dashed lines). The top left plot shows target=RNA, protein=Cas13M26. The lines corresponding to 2.5 RNA-FQ, 0.25 RNA-FQ, and 0.0025 RNA-FQ rise over time. The line corresponding to 2.5 RNA-FQ is the highest, followed by the line corresponding to 0.25 RNA-FQ, and the line corresponding to 0.025 RNA-FQ is the lowest of the three. The remaining lines are not distinguishable from the baseline. The top middle plot shows target=ssDNA, protein=Cas13M26. The lines corresponding to 2.5 RNA-FQ and 0.25 RNA-FQ rise over time. The line corresponding to 2.5 RNA-FQ is the highest, followed by the line corresponding to 0.25 RNA-FQ. The remaining lines are not distinguishable from the baseline. The top right plot shows target=dsDNA, protein=Cas13M26. None of the lines are distinguishable from baseline. The bottom left plot shows target=RNA, protein=Cas12M08. None of the lines are distinguishable from baseline. The bottom middle plot shows target=ssDNA, protein=Cas12M08. The lines corresponding to 2.5 DNA-FQ, 0.25 DNA-FQ, and 0.0025 DNA-FQ rise over time. The line corresponding to 2.5 DNA-FQ is the highest, followed by the line corresponding to 0.25 DNA-FQ, and the line corresponding to 0.025 DNA-FQ is the lowest of the three. The remaining lines are minimally distinguishable from the baseline. The bottom right plot shows target=dsDNA, protein=Cas12M08. The lines corresponding to 2.5 DNA-FQ, 0.25 DNA-FQ, and 0.0025 DNA-FQ rise over time. The line corresponding to 2.5 DNA-FQ is the highest, followed by the line corresponding to 0.25

DNA-FQ, and the line corresponding to 0.025 DNA-FQ is the lowest of the three. The remaining lines are minimally distinguishable from the baseline.

FIG. 94 shows two line plots depicting fluorescence over time. For both plots, the x-axis shows minutes from 0 to 50 in increments of 50, and the y-axis shows raw fluorescence (AU) from 0 to 2,000,000 in increments of 500,000. Both plots depict lines representing the reporters rep01—FAM-U5, rep08—A5, rep09—C5, rep10—G5, rep11—T5, rep12—TA6, rep13—TA13, rep14—TA10, rep15—T6, rep16—T7, rep19—T10, rep20—T11, rep21—T12, and rep30—beacon. The left plot shows 0 nM, and none of the lines are substantially distinguishable from baseline. The right plot shows 2.5 nM. The line corresponding to rep01—FAM-up rise over time. The remaining lines are not substantially distinguishable from baseline.

FIG. 98A shows a bar plot depicting fluorescence with different crRNA and primers. The y-axis shows normalized fluorescence from 0 to 160,000 in increments of 20,000. The x-axis shows crRNA. The plot depicts two sets of three bars. The left set depicts on-target crRNA, and the right set depicts off-target crRNA. The three bars in each set correspond to the primers, from left to right, LF+LB, LF, and LB.

FIG. 105 shows a line graph depicting fluorescence over time produced by a Cas12 DETECTR reaction in the presence of different volumes of LAMP amplicon per DETECTR reaction. The x-axis shows time in minutes from 1 to 10 in increments of 2. The y-axis shows raw fluorescence (AU) from 0 to 40,000 in increments of 5000. Fluorescence over time is plotted for 0 µL, 2 µL, 4 µL, 6 µL, 8 µL, 10 µL, 12 µL, or 14 µL of LAMP amplicon. Fluorescence increases over time for reactions containing 2 µL, 4 µL, 6 µL, 8 µL, 10 µL, or 12 µL LAMP amplicon. The line corresponding 2 µL is the highest, followed by the line corresponding to 4 µL, then the line corresponding to 6 µL, 8 µL, then the line corresponding to 10 µL, then the line corresponding to 12 µL. The lines corresponding to 0 µL and 14 µL do not rise perceptibly above baseline.

While various embodiments of the present invention have been shown and described herein, it will be apparent to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

Numbered Embodiments

The following embodiments recite non-limiting permutations of combinations of features disclosed herein. Other permutations of combinations of features are also contemplated. In particular, each of these numbered embodiments is contemplated as depending from or relating to every previous or subsequent numbered embodiment, independent of their order as listed. 1. A system for detecting a target nucleic acid, said system comprising: a) a support medium; b) a guide nucleic acid targeting a target sequence; c) a programmable nuclease capable of being activated when complexed with the guide nucleic acid and the target sequence; and d) a single stranded detector nucleic acid comprising a detection moiety, wherein the detector nucleic acid is capable of being cleaved by the activated nuclease, thereby generating a first detectable signal. 2. A system for detecting a target nucleic acid comprising: a) a reagent chamber comprising: 1) a guide nucleic acid targeting a target sequence; 2) a programmable nuclease capable of being activated when complexed with the guide nucleic acid and the target sequence; and 3) a single stranded detector nucleic acid comprising a detection moiety, wherein the detector nucleic acid is capable of being cleaved by the activated nuclease, thereby generating a first detectable signal; and b) a support medium for detection of the first detectable signal. 3. A kit for detecting a target nucleic acid in a sample comprising: a) a support medium; b) a guide nucleic acid targeting a target sequence; c) a programmable nuclease capable of being activated when complexed with the guide nucleic acid and the target sequence; and d) a single stranded detector nucleic acid comprising a detection moiety, wherein the detector nucleic acid is capable of being cleaved by the activated nuclease, thereby generating a first detectable signal. 4. A method of detecting a target nucleic acid in a sample comprising: a) contacting the sample with 1) a guide nucleic acid targeting a target sequence; 2) a programmable nuclease capable of being activated when complexed with the guide nucleic acid and the target sequence; 3) a single stranded detector nucleic acid comprising a detection moiety, wherein the detector nucleic acid is capable of being cleaved by the activated nuclease, thereby generating a first detectable signal; and b) presenting the first detectable signal using a support medium. 5. A support medium comprising: a) a guide nucleic acid targeting a target sequence on a surface of the support medium; b) a programmable nuclease capable of being activated when complexed with the guide nucleic acid and the target sequence on the surface of the support medium; c) a single stranded detector nucleic acid comprising a detection moiety, wherein the detector nucleic acid is capable of being cleaved by the activated nuclease, thereby generating a first detectable signal; and d) a biological sample on the support medium. 6. A method of detecting a target nucleic acid in a sample comprising: a) contacting the sample comprising the target nucleic acid with 1) a guide nucleic acid targeting a target sequence; 2) a programmable nuclease capable of being activated when complexed with the guide nucleic acid and the target sequence; and 3) a single stranded detector nucleic acid comprising a detection moiety, wherein the detector nucleic acid is capable of being cleaved by the activated nuclease, thereby generating a first detectable signal; b) cleaving the single stranded detector nucleic acid using the programmable nuclease that cleaves with an efficiency of 50% as measured by a change in color; and c) measuring the first detectable signal on a support medium. 7. The system, kit, method, or support medium any one of embodiments 1-6, wherein the support medium comprises a lateral flow assay device. 8. The system, kit, method, or support medium any one of embodiments 1-6, wherein the support medium comprises nitrocellulose. 9. The system, kit, method, or support medium any one of embodiments 1-6, wherein the support medium comprises cellulose. 10. The system, kit, method, or support medium any one of embodiments 1-6, wherein the support medium is a PCR plate or a PCR subset plate. 11. The system, kit, method, or support medium of embodiment 10, wherein the PCR plate has 96 wells or 384 wells. 12. The system, kit, method, or support medium of embodiment 10, wherein the PCR plate or PCR subset plate is paired with a fluorescent light reader, a visible light reader, or a mobile device. 13. The system, kit, method, or support medium of embodiment 5, wherein the support medium comprises a sample pad region, a conjugate pad region, a detection region, and an absorbent pad region. 14. The system, kit, method, or support medium of embodiment 13, wherein the conjugate pad region comprises a conjugate, wherein the conjugate comprises a nanoparticle, a gold nanoparticle, a latex nanoparticle, or a quantum dot. 15. The system, kit, method, or support medium of embodiment 13, wherein the conjugate comprises a conjugate binding molecule attached to a surface of the conjugate. 16. The system, kit, method, or support medium any one of embodiments 1-6, wherein the detection moiety comprises a fluorescent dye. 17. The system, kit, method, or support medium of embodiment 1-6, wherein the detection moiety comprises a fluorescence resonance energy transfer (FRET) pair. 18. The system or method any one of embodiments 1-6, wherein the detection moiety comprises a polypeptide. 19. The system, kit, method, or support medium of any one of embodiments 1-6, wherein the detection moiety comprises a biotin. 20. The system, kit, method, or support medium of any one of embodiments 1-6, wherein the detection moiety comprises a polysaccharide, a polymer, or a nanoparticle. 21. The system, kit, method, or support medium of embodiment 15, wherein the conjugate binding molecule binds the detection moiety. 22. The system, kit, method, or support medium of embodiment 21, wherein the conjugate binding molecule binds selectively to the detection moiety cleaved from the detector nucleic acid. 23. The system, kit, method, or support medium of embodiment 15, wherein the conjugate binding molecule comprises an antibody or a fragment of an antibody. 24. The system, kit, method, or support medium of embodiment 15, wherein the conjugate binding molecule comprises avidin or a polypeptide that binds biotin. 25. The system, kit, method, or support medium of embodiment 15, wherein the conjugate binding molecule comprises a detector moiety binding nucleic acid. 26. The system, kit, method, or support medium of embodiment 13, wherein the detection region comprises a capture molecule, wherein the capture molecule is capable of binding to the detection moiety, and a control capture molecule. 27. The system, kit, method, or support medium of embodiment 26, wherein the control capture molecule is capable of binding to a molecule in the sample, detection moiety on an uncleaved detection nucleic acid, or a molecule from the conjugate pad region. 28. The system or method of embodiment 26, wherein the capture molecule and the control capture molecule are located in spatially distinct regions on the detection region. 29. The system, kit, method, or support medium of embodiment 26, wherein the capture molecule binds the detection moiety. 30. The system, kit, method, or support medium of embodiment 29, wherein the capture molecule comprises an antibody or a fragment of an antibody. 31. The system, kit, method, or support medium of embodiment 29, wherein the first detection signal is generated by binding of the detection moiety to the capture molecule in the detection region, wherein the first detection signal indicates that the sample contained the target nucleic acid. 32. The system, kit, method, or support medium any one of embodiments 1-6, wherein the system is capable of detecting more than one type of target nucleic acid, wherein the system comprises more than one type of guide nucleic acid and more than one type of detector nucleic acid. 33. The system, kit, method, or support medium any one of embodiments 1-6, wherein the detection of the detectable signal by the support medium increases with cleaving of the detector nucleic acid. 34. The system, kit, method, or support medium any one of embodiments 1-6, wherein the detection of the detectable signal by the support medium decrease with cleaving of the detector nucleic acid. 35. The system, kit, method, or support medium of any one of embodiments 1-6, wherein the detectable signal is generated directly by the cleavage event. 36. The system, kit, method, or support medium of any one of embodiments 1-6, wherein the detectable signal is generated indirectly by the signal event. 37. The system, kit, method, or support medium of any one of embodiments 1-6, wherein a second target nucleic acid is detected on the same support medium. 38. The system, kit, method, or support medium of embodiment 37, wherein the second target nucleic acid is targeted by a second guide nucleic acid. 39. The system, kit, method, or support medium of embodiment 37, wherein second target nucleic acid is targeted by a second programmable nucleic acid. 40. The system, kit, method, or support medium of embodiment 37, wherein activation of nuclease upon complexing with the second target nucleic acid generates a second detectable signal from a second detection nucleic acid comprising a second detection moiety. 41. The system, kit, method, or support medium of embodiment 40, wherein the second detectable signal is different from the first detectable signal. 42. The system, kit, method, or support medium of embodiment 37, wherein the second target nucleic acid is a related serotype or variant of the first target nucleic acid. 43. The system, kit, method, or support medium of embodiment 37, wherein the system allows multiplexing and detection of multiple target nucleic acids on a single support medium. 44. The system, kit, method, or support medium of embodiment 43, wherein there is a guide nucleic acid specific for each of the multiple target nucleic acids. 45. The system, kit, method, or support medium of embodiment 43, wherein a conjugate pad of the support medium comprises a conjugate with a first and a second conjugate binding molecules attached to a surface of the conjugate, wherein the first and the second conjugate binding molecules bind to the a first and a second detection moieties, respectively. 46. The system, kit, method, or support medium of embodiment 43, wherein a conjugate pad of the support medium comprises a first conjugate with a first conjugate binding molecule, and a second conjugate with a second conjugate binding molecule, wherein the first and the second conjugate binding molecules bind to the a first and a second detection moieties, respectively. 47. The system, kit, method, or support medium of embodiments 45 or 46, wherein the conjugate comprises a nanoparticle, a gold nanoparticle, a latex nanoparticle, or a quantum dot. 48. The system, kit, method, or support medium of embodiment 47, wherein a detection region of the support medium comprises spatially distinct regions for a first capture molecule and a second capture molecule, wherein the first and second capture molecules bind to first and a second detection moieties, respectively. 49. The system, kit, method, or support medium of embodiment 47, wherein the second detectable signal is generated in a spatially distinct location than the first generated signal. 50. The system, kit, method, or support medium of embodiment 47, wherein the detected target nucleic acid is identified based on its spatial location on the detection region of the support medium. 51. The system, kit, method, or support medium of embodiment 47, wherein a detection region of the support medium comprises a spatially identical region for a first capture molecule and a second capture molecule, wherein the first and second capture molecules bind to first and a second detection moieties, respectively. 52. The system, kit, method, or support medium of any one of embodiments 1-6, wherein the detectable signal is not a fluorescent signal. 53. The system, kit, method, or support medium of any one of embodiments 1-6, wherein the detectable signal is a colorimetric or color-based signal. 54. The system, kit, method, or support medium of any one of embodiments 1-6, wherein the support medium comprises a barcode. 55. The system, kit, method, or support medium of embodiment 54, wherein the barcode can be scanned using a camera with a mobile application. 56. The system, kit, method, or support medium of any one of embodiments 1-6, wherein the support medium comprises a reference color guide. 57. The system, kit, method, or support medium of embodiment 56, wherein the reference color guide can be scanned using a camera with a mobile application. 58. The system, kit, method, or support medium of any one of embodiments 1-6, wherein the target nucleic acid is amplified prior to contacting it to the support medium. 59. The system, kit, method, or support medium of embodiment 58, wherein the amplification is isothermal amplification. 60. The system, kit, method, or support medium of embodiment 59, wherein the amplification comprises isothermal recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), or improved multiple displacement amplification (IMDA). 61. The system, kit, method, or support medium of any one of embodiments 1-6, wherein the sample is transferred onto the support medium. 62. The system, kit, method, or support medium of embodiment 61, wherein the transfer occurs automatically or semi-automatically in situ. 63. The system, kit, method, or support medium of any one of embodiments 1-6, wherein the support medium is placed into a reagent chamber holding the sample. 64. The system, kit, method, or support medium of any one of embodiments 1-6, wherein the target nucleic acid is not amplified prior to contacting the support medium. 65. The system, kit, method, or support medium of any one of embodiments 1-6, wherein the programmable nuclease is Cas13. 66. The system, kit, method, or support medium of embodiment 65, wherein Cas13 is Cas13a, Cas13b, Cas13c, Cas13d, or Cas13e. 67. The system, kit, method, or support medium of one of embodiments 1-6, wherein the programmable nuclease is Cas12. 68. The system, kit, method, or support medium of embodiment 67, wherein the Cas12 is Cas12a, Cas12b, Cas12c, Cas12d, or Cas12e. 69. The system, kit, method, or support medium of embodiments 1-6, wherein the programmable nuclease is Csm1, Cas9, C2c4, C2c8, C2c5, C2c10, C2c9, or casZ. 70. The system, kit, method, or support medium of any one of embodiments 1-6, wherein the guide nucleic acid targeting a target sequence is selected from a group of tiled guide nucleic acids that bind to a nucleic acid of a strain of an infection. 71. The system, kit, method, or support medium of any one of embodiments 1-6, wherein the guide nucleic acid targeting a target sequence is selected from a group of tiled guide nucleic acids that bind to a nucleic acid of a strain of HPV 16 or HPV18. 72. The system, kit, method, or support medium of any one of embodiments 1-6, wherein the sample comprises a blood sample, a serum sample, a plasma sample, a saliva sample, a urine sample, a sputum sample, a mucosal sample, a peritoneal fluid sample, a tissue sample, an exudate, an effusion, or a cell free DNA sample. 73. The system, kit, method, or support medium of any one of embodiments 1-6, wherein the sample comprises a non-human animal sample. 74. The system, kit, method, or support medium of any one of embodiments 1-6, wherein the sample comprises a plant sample, a fungal sample, a bacterial sample, or a viral sample. 75. The system, kit, method, or support medium of any one of embodiments 1-6, wherein the sample comprises a soil sample, or an environmental sample. 76. The system, kit, method, or support medium of any one of embodiments 1-6, wherein the guide nucleic acid comprises a nucleic acid capable of detecting HIV, HPV, *chlamydia*, gonorrhea, syphilis, trichomoniasis, sexually transmitted infection, malaria, Dengue fever, ebola, chikungunya, leishmaniasis, or combinations thereof 77. The system, kit, method, or support medium of any one of embodiments 1-6, wherein the sample comprises a human sample. 78. The system, kit, method, or support medium of any one of embodiments 1-6, wherein the guide nucleic acid comprises a nucleic acid capable of detecting a gene. 79. The system, kit, method, or support medium of any one of embodiments 78, wherein the gene is expressed or over expressed in a cancer or is expressed in a genetic disorder. 80. The system, kit, method, or support medium of any one of embodiments 1-6, wherein the single stranded detector nucleic acid comprises: 1) a nucleic acid comprising at least two nucleotides, 2) a fluorophore, and 3) a fluorescence quencher, wherein the fluorophore and the fluorescence quencher are linked by the nucleic acid. 81. The system, kit, method, or support medium of any one of embodiments 1-6, wherein the single stranded detector nucleic acid comprises: 1) a nucleic acid comprising at least 3 unmodified nucleotides, wherein at least two nucleotides are unmodified ribonucleotides and at least one nucleotide is an unmodified deoxyribonucleotide; 2) a fluorophore, and 3) a fluorescence quencher, wherein the fluorophore and the fluorescence quencher are linked by the nucleic acid. 82. The system, kit, method, or support medium of any one of embodiments 1-6, wherein the single stranded detector nucleic acid comprises: 1) a nucleic acid comprising at least 3 unmodified nucleotides, wherein at least two unmodified nucleotides are unmodified uracil ribonucleotides and at least one nucleotide is an unmodified deoxyribonucleotide; 2) a fluorophore, and 3) a fluorescence quencher, wherein the fluorophore and the fluorescence quencher are linked by the nucleic acid. 83. The system, kit, method, or support medium of embodiment 80, wherein the at least two nucleotides are at least two uracil ribonucleotides. 84. The system, kit, method, or support medium of embodiment 80, wherein the fluorophore is an infrared fluorescent moiety. 85. The system, kit, method, or support medium of embodiment 80, wherein the nucleic acid comprises 5 nucleotides, 8 nucleotides, or 10 nucleotides. 86. The system, kit, method, or support medium of embodiment 80, wherein the fluorophore is 5' 6-FAM and the fluorescence quencher or non-fluorescent fluorescence quencher is 3' IABkFQ. 87. The system, kit, method, or support medium of embodiment 80, wherein the fluorophore is 5' 5IRD700 and the fluorescence quencher or non-fluorescent fluorescence quencher is 3' IRQC1N. 88. The system, kit, method, or support medium of any one of embodiments 1-6, wherein the single stranded detector nucleic acid comprises any one of SEQ ID NO: 1-SEQ ID NO: 8. 89. The system, kit, or support medium of any one of embodiments 1-3, further comprising a biological sample. 90. The system, kit, or support medium of any one of embodiments 1-3, further comprising a urine sample. 91. The method of embodiment 6, wherein the change in color is colorimetric signal or a signal visible by eye. 92. The method of embodiment 6, wherein cleaving the single stranded detector nucleic acid using the programmable nuclease that cleaves with an efficiency of 50% as measured by a change in color. 93. The method of embodiment 6, wherein the first detectable signal is detectable within 60 minutes of the contacting. 94. The system, kit, method, or support medium of any one of embodiments 1-6, wherein the single stranded detector nucleic acid is at least one population of the single stranded detector nucleic acid. 95. The system, kit, method, or support medium of any one of embodiments 1-6, wherein the single stranded detector nucleic acid is any single stranded detector nucleic acid of Table 4. 96. The system, kit, method, or support medium of any one of embodiments 1-6, wherein the target sequence comprises a single nucleotide polymorphism. 97. The system, kit, method, or support medium of embodiment 96, wherein the single nucleotide polymorphism confers resistance to a treatment. 98. The system, kit, method, or support medium of embodiment 97, wherein the treatment is an antibiotic treatment. 99. A method for detecting a target nucleic acid, said system comprising: a) providing a sample from a subject; b) introducing the sample into a fluidic device; c) incubating the sample with a pre-complexed Cas mixture in the fluidic system in an incubation and detection chamber; and d) generating a detection signal in the fluidic system. 100. The method of embodiment 99, wherein prior to step c), the sample is amplified by incubation with amplification mix. 101. The method of embodiment 99, wherein prior to step b), the sample is filtered using a filtration device for sample preparation. 102. The method of embodiment 101, wherein the filtration device comprises a narrow tip or glass capillary for collection of the sample. 103. The method of embodiment 102, wherein the filtration device comprises a channel to carry the sample. 104. The method of embodiment 103, wherein the channel comprises lysis buffer. 105. The method of embodiment 103, wherein the channel comprises metal, plastic, or a biocompatible material. 106. The method of embodiment 101, wherein the filtration device further comprises a solution of reagents that will lyse a cell. 107. The method of embodiment 106, wherein the solution comprises chaotropic agents, detergents, salts, or any combination thereof 108. The method of embodiment 106, wherein the solution comprises high osmolality, ionic strength pH, or any combination thereof 109. The method of embodiment 1-6, wherein the solution comprises a detergent. 110. The method of embodiment 109, wherein the detergent comprises sodium dodecyl sulphate (SDS) or cetyl trimethylammonium bromide (CTAB). 111. The method of embodiment 99, wherein the fluidic device is manufactured from a plastic polymers, poly-methacrylate (PMMA), cyclic olefin polymer (COP), cyclic olefin copolymer (COC), polyethylene (PE), high-density polyethylene (HDPE), polypropylene (PP), glass, silicon, or any combination thereof 112. The method of embodiment 99, wherein features of the fluidic device or embossed using injection molding, (2) micromilled or micro-engraved using computer numerical control (CNC) micromachining, or non-contact laser drilling (by means of a CO2 laser source); (3) incorporated via additive manufacturing, and/or (4) incorporated via photolithographic methods. 113. The method of embodiment 99, wherein the fluidic device comprises at least three pumps. 114. The method of embodiment 99, wherein the fluidic device comprises at least three reservoirs. 115. The method of embodiment 99, wherein the fluidic device comprises up to four microvalves. 116. The method of embodiment 100, wherein amplification comprises loop-mediated isothermal amplification (LAMP), strand displacement amplification (SDA), recombinase polymerase amplification (RPA), helicase dependent amplification (HDA), multiple displacement amplification (MDA), rolling circle amplification (RCA), nucleic acid sequence-based amplification (NASBA), or polymerase chain reaction (PCR). 117. The method of embodiment 115, wherein the microvalves comprise electrokinetic microvalves, pneumatic microvalves, vacuum microvalves, capillary microvalves, pinch microvalves, phase-change microvalves, or burst microvalves. 118. The method of embodiment 99, wherein after step c), sample, amplification mix, and pre-complexed Cas mix are mixed in a serpentine channel and led to a chamber. 119. The method of embodiment 118, wherein the chamber is thermoregulated. 120. The method of embodiment 99, wherein the detection signal is generated by a single stranded detector nucleic acid comprising a detection moiety, wherein the detector nucleic acid is capable of being cleaved by an activated nuclease, thereby generating the detectable signal. 121. The method of embodiment 120, wherein the detection signal is detected by fluorescence, electrochemical detection, or electrochemiluminescence. 122. The method of embodiment 99, wherein a fluorimeter is position directly above the incubation and detection chamber. 123. The method of embodiment 99, wherein the top surface of the incubation and detection chamber is functionalized with nucleic acid molecules conjugated with a biotin moiety. 124. The method of embodiment 99, wherein the bottom surface of the incubation and detection chamber operates as an electrode and is coated with streptavidin molecules. 125. The method of any one of embodiments 123-124, wherein the pre-complexed Cas mix with an amplified target nucleic acid flows into the incubation and detection chamber, is activated at a higher temperature, and cleaves the nucleic acid molecules conjugated with the biotin moiety. 126. The method of embodiment 125, wherein the cleaved biotin diffuses to the bottom surface and binds streptavidin, resulting in an increase in current. 127. The method of embodiment 99, wherein an electroactive mediator moiety conjugated to individual nucleotides of nucleic acid molecules (ssRNA, ssDNA or ssRNA/DNA hybrid molecules) are immobilized on the bottom surface of the incubation and detection chamber. 128. The method of embodiment 127, wherein the electroactive mediator moiety is ferrocene (Fc). 129. The method of embodiment 127, wherein the pre-complexed Cas mix with an amplified target nucleic acid flows into the incubation and detection chamber, is activated at a higher temperature, and cleaves immobilized Fc-conjugated nucleic acid molecules, resulting in a decrease in current. 130. The method of embodiment 99, wherein the incubation and detection chambers are separate. 131. The method of embodiment 130, wherein a top surface of the incubation chamber is coated with ssNA conjugated to invertase. 132. The method of embodiment 130, wherein a bottom surface of the incubation chamber comprises a thin-film planar heater. 133. The method of embodiment 130, wherein a top surface of the detection chamber comprises a camera or optical sensor. 134. The method of embodiment 130, wherein a bottom surface of the detection chamber comprises a thin-film planar heater. 135. The method of embodiment 132, wherein detection comprises optical readout using DNS or electrochemical readout with an electrochemical analyzer or glucometer. 136. The method of embodiment 131, wherein the pre-Complexed Cas mix with an amplified target nucleic acid flows into the incubation and detection chamber, is activated, and catalyzes breakdown of sucrose to fructose and glucose. 137. The method of embodiment 136, wherein the amount of fructose and glucose is linked to a colorimetric reaction. 138. The method of embodiment 136, wherein the pre-Complexed Cas mix with an amplified target nucleic acid, and glucose flows into a separate chamber wherein the separate chamber comprises glucose oxidase dried on its surface and catalyzes the oxidation of glucose to hydrogen peroxide and D-glucono-δ-lactone. 139. A system for detecting a target nucleic acid by a Cas reaction, said system comprising a fluidic device, wherein the fluidic device comprises an incubation and detection chamber. 140. The system of embodiment 139, wherein features of the fluidic device or embossed using injection molding, (2) micro-milled or micro-engraved using computer numerical control (CNC) micromachining, or non-contact laser drilling (by means of a CO2 laser source); (3) incorporated via additive manufacturing, and/or (4) incorporated via photolithographic methods. 141. The system of embodiment 139, wherein the fluidic device comprises at least three pumps. 142. The system of embodiment 139, wherein the fluidic device comprises at least three reservoirs. 143. The system of embodiment 139, wherein the fluidic device comprises up to four microvalves. 144. The system of embodiment 143, wherein the microvalves comprise electrokinetic microvalves, pneumatic microvalves, vacuum microvalves, capillary microvalves, pinch microvalves, phase-change microvalves, or burst microvalves. 145. The system of embodiment 139, wherein the top surface of the incubation and detection chamber is functionalized with nucleic acid molecules conjugated with a biotin moiety. 146. The system of embodiment 139, wherein the bottom surface of the incubation and detection chamber operates as an electrode and is coated with streptavidin molecules. 147. The system of embodiment 139, wherein an electroactive mediator moiety conjugated to individual nucleotides of nucleic acid molecules (ssRNA, ssDNA or ssRNA/DNA hybrid molecules) are immobilized on the bottom surface of the incubation and detection chamber. 148. The system of embodiment 147, wherein the electroactive mediator moiety is ferrocene (Fc). 149. The system of embodiment 139, wherein the incubation and detection chambers are separate. 150. The system of embodiment 149, wherein a top surface of the incubation chamber is coated with ssNA conjugated to invertase. 151. The system of embodiment 149, wherein a bottom surface of the incubation chamber comprises a thin-film planar heater. 152. The system of embodiment 149, wherein a top surface of the detection chamber comprises a camera or optical sensor. 153. The system of embodiment 149, wherein a bottom surface of the detection chamber comprises a thin-film planar heater. 154. The system of embodiment 149, wherein the fluidic device comprises a separate chamber comprising glucose oxidase dried on its surface. 155. The method of any one of embodiments 99-138, wherein the pre-complexed Cas mixture comprises guide RNA complementary to the target nucleic acid and a Cas protein.

The following embodiments recite permutations of combinations of features disclosed herein. In some cases, permutations of combinations of features disclosed herein are non-limiting. In other cases permutations of combinations of features disclosed herein are limiting. Other permutations of combinations of features are also contemplated. In particular, each of these numbered embodiments is contemplated as depending from or relating to every previous or subsequent numbered embodiment, independent of their order as listed. 1. A system for detecting a target nucleic acid, said system comprising: a) a support medium; b) a guide nucleic acid targeting a target sequence; c) a programmable nuclease capable of being activated when complexed with the guide nucleic acid and the target sequence; and d) a single stranded detector nucleic acid comprising a detection moiety, wherein the detector nucleic acid is capable of being cleaved by the activated nuclease, thereby generating a first detectable signal. 2. A system for detecting a target nucleic acid comprising: a) a reagent chamber comprising: 1) a guide nucleic acid targeting a target sequence; 2) a programmable nuclease capable of being activated when complexed with the guide nucleic acid and the target sequence; and 3) a single stranded detector nucleic acid comprising a detection moiety, wherein the detector nucleic acid is capable of being cleaved by the activated nuclease, thereby generating a first detectable signal; and b) a support medium for detection of the first detectable signal. 3. A kit for detecting a target nucleic acid in a sample comprising: a) a support medium; b) a guide nucleic acid targeting a target sequence; c) a programmable nuclease capable of being activated when complexed with the guide nucleic acid and the target sequence; and d) a single stranded detector nucleic acid comprising a detection moiety, wherein the detector nucleic acid is capable of being cleaved by the activated nuclease, thereby generating a first detectable signal. 4. A method of detecting a target nucleic acid in a sample comprising: a) contacting the sample with 1) a guide nucleic acid targeting a target sequence; 2) a programmable nuclease capable of being activated when complexed with the guide nucleic acid and the target sequence; 3) a single stranded detector nucleic acid comprising a detection moiety, wherein the detector nucleic acid is capable of being cleaved by the activated nuclease, thereby generating a first detectable signal; and b) presenting the first detectable signal using a support medium. 5. A support medium comprising: a) a guide nucleic acid targeting a target sequence on a surface of the support medium; b) a programmable nuclease capable of being activated when complexed with the guide nucleic acid and the target sequence on the surface of the support medium; c) a single stranded detector nucleic acid comprising a detection moiety, wherein the detector nucleic acid is capable of being cleaved by the activated nuclease, thereby generating a first detectable signal; and d) a biological sample on the support medium. 6. A method of detecting a target nucleic acid in a sample comprising: a) contacting the sample comprising the target nucleic acid with 1) a guide nucleic acid targeting a target sequence; 2) a programmable nuclease capable of being activated when complexed with the guide nucleic acid and the target sequence; and 3) a single stranded detector nucleic acid comprising a detection moiety, wherein the detector nucleic acid is capable of being cleaved by the activated nuclease, thereby generating a first detectable signal; b) cleaving the single stranded detector nucleic acid using the programmable nuclease that cleaves with an efficiency of 50% as measured by a change in color; and c) measuring the first detectable signal on a support medium. 7. A system for detecting a target nucleic acid, said system comprising: a support medium; a guide nucleic acid targeting a target sequence, wherein the guide nucleic acid has a sequence selected from a group of tiled guide nucleic acid that correspond to nucleic acid of a strain of an infectious agent; a programmable nuclease that is activated when complexed with the guide nucleic acid and the target sequence; and a single stranded detector nucleic acid comprising a detection moiety, wherein the detectable moiety is detected by a detectable signal upon cleavage by the activated programmable nuclease. 8. A system for detecting a target nucleic acid, said system comprising: a support medium; a guide nucleic acid targeting a target sequence; a programmable nuclease that is activated when complexed with the guide nucleic acid and the target sequence; and a single stranded detector nucleic acid comprising a detection moiety, wherein the detectable moiety is detected by a detectable signal upon cleavage by the activated programmable nuclease and wherein the single stranded detector nucleic acid comprises at least 3 nucleotides, wherein at least two nucleotides are ribonucleotides and at least one nucleotide is a deoxyribonucleotide. 9. A support medium comprising: a first guide nucleic acid targeting a target sequence on a surface of the support medium; at least one additional guide nucleic acid targeting a different portion of the target sequence than the first guide nucleic acid; a programmable nuclease that is activated when complexed to the guide nucleic acid and the target sequence on the surface of the support medium; a single stranded detector nucleic acid comprising a detection moiety, wherein the detectable moiety is detected upon cleavage by the activated programmable nuclease by a detectable signal; and a biological sample on the support medium. 10. A method of detecting a target nucleic acid comprising: contacting a sample comprising a target nucleic acid to a surface of a support medium comprising a programmable nuclease that is activated when complexed to a guide nucleic acid and the target nucleic acid, and a single stranded detector nucleic acid comprising a detection moiety; generating a detectable signal in more than 15 minutes; and assaying for the detection moiety. 11. A method comprising contacting a sample to a plurality of programmable sequence specific nucleases, wherein the plurality of programmable nucleases comprises at least one programmable nuclease that is activated when complexed to a guide nucleic acid and a target DNA and at least one programmable nuclease that is activated when complexed to a guide nucleic acid and a target RNA, a single stranded detector DNA comprising a first detection moiety, a single stranded detector RNA comprising a second detection moiety; and assaying for the first detection moiety, the second detection moiety, or the combination thereof 12. A method of disease assessment in a sample, comprising: a) assaying for a pathogen nucleic acid in the sample using a first programmable nuclease, and b) assaying for a pathogen resistance locus in the sample using a second programmable nuclease, wherein the first programmable nuclease and the second programmable nuclease do not cleave a common detector nucleic acid site upon activation. 13. A method of nucleic acid assessment in a sample, comprising a) assaying for a first nucleic acid in the sample using a first programmable nuclease, and b) assaying for a second nucleic acid in the sample using a second programmable nuclease, wherein the first programmable nuclease and the second programmable nuclease do not cleave a common detector nucleic acid site upon activation. 14. A method of circulating nucleic acid quantification, comprising: assaying for a target nucleic acid from circulating nucleic acid in a first aliquot of a sample, assaying for a control nucleic acid in a second aliquot of the sample, and quantifying the target nucleic acid target in the first aliquot by measuring a signal produced by cleavage of a detector nucleic acid. 15. A method of nucleic acid detection from a raw sample, comprising: protease treating the sample for no more than 15 minutes, preamplifying the sample for no more than 15 minutes, subjecting the sample to a programmable nuclease-mediated detection, and assaying nuclease mediated detection. 16. A method of assaying comprising a single assay for a microorganism species using a first programmable nuclease and an antibiotic resistance pattern in a microorganism using a second programmable nuclease. 17. A method comprising: obtaining a serum sample from a subject; and identifying a disease status of the subject. 18. A method of quantification for a disease panel, comprising: assaying for a plurality of unique target nucleic acids in a plurality of aliquots from a sample, assaying for a control nucleic acid control in a second aliquot of the sample, and quantifying a plurality of signals of the plurality of unique target nucleic acids by measuring signals produced by cleavage of detector nucleic acids compared to the signal produced in the second aliquot. 19. A method for detecting a target nucleic acid comprising: contacting a target nucleic acid to a pool of guide nucleic acids and a programmable nuclease, wherein a guide nucleic acid of the pool of guide nucleic acids has a sequence selected from a group of tiled guide nucleic acid that correspond to nucleic acid of a target nucleic acid; and assaying for a signal produce by cleavage of at least some detector nucleic acids of a population of detector nucleic acids. 20. The system, kit, method, or support medium of any one of embodiments 1-6, wherein the support medium comprises a lateral flow assay device. 21. The system, kit, method, or support medium of any one of embodiments 1-6, wherein the support medium comprises nitrocellulose. 22. The system, kit, method, or support medium of any one of embodiments 1-6, wherein the support medium comprises cellulose. 23. The system, kit, method, or support medium of any one of embodiments 1-6, wherein the support medium is a PCR plate or a PCR subset plate. 24. The system, kit, method, or support medium of embodiment 23, wherein the PCR plate has 96 wells or 384 wells. 25. The system, kit, method, or support medium of embodiment 23, wherein the PCR plate or PCR subset plate is paired with a fluorescent light reader, a visible light reader, or a mobile device. 26. The system, kit, method, or support medium of embodiment 5, wherein the support medium comprises a sample pad region, a conjugate pad region, a detection region, and an absorbent pad region. 27. The system, kit, method, or support medium of embodiment 26, wherein the conjugate pad region comprises a conjugate, wherein the conjugate comprises a nanoparticle, a gold nanoparticle, a latex nanoparticle, or a quantum dot. 28. The system, kit, method, or support medium of embodiment 26, wherein the conjugate comprises a conjugate binding molecule attached to a surface of the conjugate. 29. The system, kit, method, or support medium of any one of embodiments 1-6, wherein the detection moiety comprises a fluorescent dye. 30. The system, kit, method, or support medium of any one of claims 1-6, wherein the detection moiety comprises a fluorescence resonance energy transfer (FRET) pair. 31. The system, kit, method, or support medium of any one of embodiments 1-6, wherein the detection moiety comprises a polypeptide. 32. The system, kit, method, or support medium of any one of embodiments 1-6, wherein the detection moiety comprises a biotin. 33. The system, kit, method, or support medium of any one of embodiments 1-6, wherein the detection moiety comprises a polysaccharide, a polymer, or a nanoparticle. 34. The system, kit, method, or support medium of embodiment 28, wherein the conjugate binding molecule binds the detection moiety. 35. The system, kit, method, or support medium of embodiment 34, wherein the conjugate binding molecule binds selectively to the detection moiety cleaved from the detector nucleic acid. 36. The system, kit, method, or support medium of embodiment 28, wherein the conjugate binding molecule comprises an antibody or a fragment of an antibody. 37. The system, kit, method, or support medium of embodiment 28, wherein the conjugate binding molecule comprises avidin or a polypeptide that binds biotin. 38. The system, kit, method, or support medium of embodiment 28, wherein the conjugate binding molecule comprises a detector moiety binding nucleic acid. 39. The system, kit, method, or support medium of embodiment 26, wherein the detection region comprises a capture molecule, wherein the capture molecule is capable of binding to the detection moiety, and a control capture molecule. 40. The system, kit, method, or support medium of embodiment 39, wherein the control capture molecule is capable of binding to a molecule in the sample, detection moiety on an uncleaved detection nucleic acid, or a molecule from the conjugate pad region. 41. The system, kit, method, or support medium of embodiment 39, wherein the capture molecule and the control capture molecule are located in spatially distinct regions on the detection region. 42. The system, kit, method, or support medium of embodiment 39, wherein the capture molecule binds the detection moiety. 43. The system, kit, method, or support medium of embodiment 42, wherein the capture molecule comprises an antibody or a fragment of an antibody. 44. The system, kit, method, or support medium of embodiment 42, wherein the first detection signal is generated by binding of the detection moiety to the capture molecule in the detection region, wherein the first detection signal indicates that the sample contained the target nucleic acid. 45. The system, kit, method, or support medium of any one of embodiments 1-6, wherein the system is capable of detecting more than one type of target nucleic acid, wherein the system comprises more than one type of guide nucleic acid and more than one type of detector nucleic acid. 46. The system, kit, method, or support medium of any one of embodiments 1-6, wherein the detection of the detectable signal by the support medium increases with cleaving of the detector nucleic acid. 47. The system, kit, method, or support medium of any one of embodiments 1-6, wherein the detection of the detectable signal by the support medium decrease with cleaving of the detector nucleic acid. 48. The system, kit, method, or support medium of any one of embodiments 1-6, wherein the detectable signal is generated directly by the cleavage event. 49. The system, kit, method, or support medium of any one of embodiments 1-6, wherein the detectable signal is generated indirectly by the signal event. 50. The system, kit, method, or support medium of any one of embodiments 1-6, wherein a second target nucleic acid is detected on the same support medium. 51. The system, kit, method, or support medium of embodiment 50, wherein the second target nucleic acid is targeted by a second guide nucleic acid. 52. The system, kit, method, or support medium of embodiment 37, wherein second target nucleic acid is targeted by a second programmable nucleic acid. 53. The system, kit, method, or support medium of embodiment 50, wherein activation of nuclease upon complexing with the second target nucleic acid generates a second detectable signal from a second detection nucleic acid comprising a second detection moiety. 54. The system, kit, method, or support medium of embodiment 53, wherein the second detectable signal is different from the first detectable signal. 55. The system, kit, method, or support medium of embodiment 50, wherein the second target nucleic acid is a related serotype or variant of the first target nucleic acid. 56. The system, kit, method, or support medium of embodiment 50, wherein the system allows multiplexing and detection of multiple target nucleic acids on a single support medium. 57. The system, kit, method, or support medium of embodiment 56, wherein there is a guide nucleic acid specific for each of the multiple target nucleic acids. 58. The system, kit, method, or support medium of embodiment 56, wherein a conjugate pad of the support medium comprises a conjugate with a first and a second conjugate binding molecules attached to a surface of the conjugate, wherein the first and the second conjugate binding molecules bind to the a first and a second detection moieties, respectively. 59. The system, kit, method, or support medium of embodiment 56, wherein a conjugate pad of the support medium comprises a first conjugate with a first conjugate binding molecule, and a second conjugate with a second conjugate binding molecule, wherein the first and the second conjugate binding molecules bind to the a first and a second detection moieties, respectively. 60. The system, kit, method, or support medium of embodiments 58 or 59, wherein the conjugate comprises a nanoparticle, a gold nanoparticle, a latex nanoparticle, or a quantum dot. 61. The system, kit, method, or support medium of embodiment 60, wherein a detection region of the support medium comprises spatially distinct regions for a first capture molecule and a second capture molecule, wherein the first and second capture molecules bind to first and a second detection moieties, respectively. 62. The system, kit, method, or support medium of embodiment 60, wherein the second detectable signal is generated in a spatially distinct location than the first generated signal. 63. The system, kit, method, or support medium of embodiment 60, wherein the detected target nucleic acid is identified based on its spatial location on the detection region of the support medium. 64. The system, kit, method, or support medium of embodiment 60, wherein a detection region of the support medium comprises a spatially identical region for a first capture molecule and a second capture molecule, wherein the first and second capture molecules bind to first and a second detection moieties, respectively. 65. The system, kit, method, or support medium of any one of embodiments 1-6, wherein the detectable signal is not a fluorescent signal. 66. The system, kit, method, or support medium of any one of embodiments 1-6, wherein the detectable signal is a colorimetric or color-based signal. 67. The system, kit, method, or support medium of any one of embodiments 1-6, wherein the support medium comprises a barcode. 68. The system, kit, method, or support medium of embodiment 67, wherein the barcode can be scanned using a camera with a mobile application. 69. The system, kit, method, or support medium of any one of embodiments 1-6, wherein the support medium comprises a reference color guide. 70. The system, kit, method, or support medium of embodiment 69, wherein the reference color guide can be scanned using a camera with a mobile application. 71. The system, kit, method, or support medium of any one of embodiments 1-6, wherein the target nucleic acid is amplified prior to contacting it to the support medium. 72. The system, kit, method, or support medium of claim 71, wherein the amplification is isothermal amplification. 73. The system, kit, method, or support medium of embodiment 72, wherein the amplification comprises isothermal recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), or improved multiple displacement amplification (IMDA). 74. The system, kit, method, or support medium of any one of embodiments 1-6, wherein the sample is transferred onto the support medium. 75. The system, kit, method, or support medium of embodiment 74, wherein the transfer occurs automatically or semi-automatically in situ. 76. The system, kit, method, or support medium of any one of embodiments 1-6, wherein the support medium is placed into a reagent chamber holding the sample. 77. The system, kit, method, or support medium of any one of embodiments 1-6, wherein the target nucleic acid is not amplified prior to contacting the support medium. 78. The system, kit, method, or support medium of any one of embodiments 1-6, wherein the programmable nuclease is Cas13. 79. The system, kit, method, or support medium of embodiment 78, wherein Cas13 is Cas13a, Cas13b, Cas13c, Cas13d, or Cas13e. 80.

The system, kit, method, or support medium of any one of embodiments 1-6, wherein the programmable nuclease is Cas12. 81. The system, kit, method, or support medium of embodiment 80, wherein the Cas12 is Cas12a, Cas12b, Cas12c, Cas12d, or Cas12e. 82. The system, kit, method, or support medium of any one of embodiments 1-6, wherein the programmable nuclease is Csm1, Cas9, C2c4, C2c8, C2c5, C2c10, C2c9, or casZ. 83. The system, kit, method, or support medium of any one of embodiments 1-6, wherein the guide nucleic acid targeting a target sequence is selected from a group of tiled guide nucleic acids that bind to a nucleic acid of a strain of an infection. 84. The system, kit, method, or support medium of any one of embodiments 1-6, wherein the guide nucleic acid targeting a target sequence is selected from a group of tiled guide nucleic acids that bind to a nucleic acid of a strain of HPV 16 or HPV18. 85. The system, kit, method, or support medium of any one of embodiments 1-6, wherein the sample comprises a blood sample, a serum sample, a plasma sample, a saliva sample, a urine sample, a sputum sample, a mucosal sample, a peritoneal fluid sample, a tissue sample, an exudate, an effusion, or a cell free DNA sample. 86. The system, kit, method, or support medium of any one of embodiments 1-6, wherein the sample comprises a non-human animal sample. 87. The system, kit, method, or support medium of any one of embodiments 1-6, wherein the sample comprises a plant sample, a fungal sample, a bacterial sample, or a viral sample. 88. The system, kit, method, or support medium of any one of embodiments 1-6, wherein the sample comprises a soil sample, or an environmental sample. 89. The system, kit, method, or support medium of any one of embodiments 1-6, wherein the guide nucleic acid comprises a nucleic acid capable of detecting HIV, HPV, *chlamydia*, gonorrhea, syphilis, trichomoniasis, sexually transmitted infection, malaria, Dengue fever, ebola, chikungunya, leishmaniasis, or combinations thereof 90. The system, kit, method, or support medium of any one of embodiments 1-6, wherein the sample comprises a human sample. 91. The system, kit, method, or support medium of any one of embodiments 1-6, wherein the guide nucleic acid comprises a nucleic acid capable of detecting a gene. 92. The system, kit, method, or support medium of embodiment 91, wherein the gene is expressed or over expressed in a cancer or is expressed in a genetic disorder. 93. The system, kit, method, or support medium of any one of embodiments 1-6, wherein the single stranded detector nucleic acid comprises: 1) a nucleic acid comprising at least two nucleotides, 2) a fluorophore, and 3) a fluorescence quencher, wherein the fluorophore and the fluorescence quencher are linked by the nucleic acid. 94. The system, kit, method, or support medium of any one of embodiments 1-6, wherein the single stranded detector nucleic acid comprises: 1) a nucleic acid comprising at least 3 unmodified nucleotides, wherein at least two nucleotides are unmodified ribonucleotides and at least one nucleotide is an unmodified deoxyribonucleotide; 2) a fluorophore, and 3) a fluorescence quencher, wherein the fluorophore and the fluorescence quencher are linked by the nucleic acid. 95. The system, kit, method, or support medium of any one of embodiments 1-6, wherein the single stranded detector nucleic acid comprises: 1) a nucleic acid comprising at least 3 unmodified nucleotides, wherein at least two unmodified nucleotides are unmodified uracil ribonucleotides and at least one nucleotide is an unmodified deoxyribonucleotide; 2) a fluorophore, and 3) a fluorescence quencher, wherein the fluorophore and the fluorescence quencher are linked by the nucleic acid. 96. The system, kit, method, or support medium of embodiment 93, wherein the at least two nucleotides are at least two uracil ribonucleotides. 97. The system, kit, method, or support medium of embodiment 93, wherein the fluorophore is an infrared fluorescent moiety. 98. The system, kit, method, or support medium of embodiment 93, wherein the nucleic acid comprises 5 nucleotides, 8 nucleotides, or 10 nucleotides. 99. The system, kit, method, or support medium of embodiment 93, wherein the fluorophore is 5' 6-FAM and the fluorescence quencher or non-fluorescent fluorescence quencher is 3' IABkFQ. 100. The system, kit, method, or support medium of embodiment 93, wherein the fluorophore is 5' 5IRD700 and the fluorescence quencher or non-fluorescent fluorescence quencher is 3' IRQC1N. 101. The system, kit, method, or support medium of any one of embodiments 1-6, wherein the single stranded detector nucleic acid comprises any one of SEQ ID NO: 1-SEQ ID NO: 8. 102. The system or kit of any one of embodiments 1-3, further comprising a biological sample. 103. The system or kit of any one of embodiments 1-3, further comprising a urine sample. 104. The method of embodiment 6, wherein the change in color is colorimetric signal or a signal visible by eye. 105. The method of embodiment 6, wherein cleaving the single stranded detector nucleic acid using the programmable nuclease that cleaves with an efficiency of 50% as measured by a change in color. 106. The method of embodiment 6, wherein the first detectable signal is detectable within 60 minutes of the contacting. 107. The system, kit, method, or support medium of any one of embodiments 1-6, wherein the single stranded detector nucleic acid is at least one population of the single stranded detector nucleic acid. 108. The system, kit, method, or support medium of any one of embodiments 1-6, wherein the single stranded detector nucleic acid is any single stranded detector nucleic acid of Table 4. 109. The system, kit, method, or support medium of any one of embodiments 1-6, wherein the target sequence comprises a single nucleotide polymorphism. 110. The system, kit, method, or support medium of embodiment 109, wherein the single nucleotide polymorphism confers resistance to a treatment. 111. The system, kit, method, or support medium of embodiment 110, wherein the treatment is an antibiotic treatment. 112. A method for detecting a target nucleic acid, said system comprising: a) providing a sample from a subject; b) introducing the sample into a fluidic device; c) incubating the sample with a pre-complexed programmable nuclease mixture in the fluidic system in an incubation and detection chamber; and d) generating a detection signal in the fluidic system. 113. The method of embodiment 112, wherein prior to step c), the sample is amplified by incubation with amplification mix. 114. The method of embodiment 112, wherein prior to step b), the sample is filtered using a filtration device for sample preparation. 115. The method of embodiment 114, wherein the filtration device comprises a narrow tip or glass capillary for collection of the sample. 116. The method of embodiment 115, wherein the filtration device comprises a channel to carry the sample. 117. The method of embodiment 116, wherein the channel comprises lysis buffer. 118. The method of embodiment 116, wherein the channel comprises metal, plastic, or a biocompatible material. 119. The method of embodiment 114, wherein the filtration device further comprises a solution of reagents that will lyse a cell. 120. The method of embodiment 119, wherein the solution comprises chaotropic agents, detergents, salts, or any combination thereof 121. The method of embodiment 119, wherein the solution comprises high osmolality, ionic strength pH, or any combination thereof 122. The method of embodiment 119, wherein the solution comprises a detergent. 123. The method of embodiment 122, wherein the detergent comprises sodium dodecyl sulphate (SDS) or cetyl trimethylammonium bromide (CTAB). 124. The method of embodiment 112, wherein the fluidic device is manufactured from a plastic polymers, poly-methacrylate (PMMA), cyclic olefin polymer (COP), cyclic olefin copolymer (COC), polyethylene (PE), high-density polyethylene (HDPE), polypropylene (PP), glass, silicon, or any combination thereof 125. The method of embodiment 112, wherein features of the fluidic device or embossed using injection molding, (2) micro-milled or micro-engraved using computer numerical control (CNC) micromachining, or non-contact laser drilling (by means of a CO2 laser source); (3) incorporated via additive manufacturing, and/or (4) incorporated via photolithographic methods. 126. The method of embodiment 112, wherein the fluidic device comprises at least three pumps. 127. The method of embodiment 112, wherein the fluidic device comprises at least three reservoirs. 128. The method of embodiment 112, wherein the fluidic device comprises up to four microvalves. 129. The method of embodiment 113, wherein amplification comprises loop-mediated isothermal amplification (LAMP), strand displacement amplification (SDA), recombinase polymerase amplification (RPA), helicase dependent amplification (HDA), multiple displacement amplification (MDA), rolling circle amplification (RCA), nucleic acid sequence-based amplification (NASBA), or polymerase chain reaction (PCR). 130. The method of embodiment 128, wherein the microvalves comprise electro-kinetic microvalves, pneumatic microvalves, vacuum microvalves, capillary microvalves, pinch microvalves, phase-change microvalves, or burst microvalves. 131. The method of embodiment 112, wherein after step c), sample, amplification mix, and pre-complexed programmable nuclease mix are mixed in a serpentine channel and led to a chamber. 132. The method of embodiment 131, wherein the chamber is thermoregulated. 133. The method of embodiment 112, wherein the detection signal is generated by a single stranded detector nucleic acid comprising a detection moiety, wherein the detector nucleic acid is capable of being cleaved by an activated nuclease, thereby generating the detectable signal. 134. The method of embodiment 133, wherein the detection signal is detected by fluorescence, electrochemical detection, or electrochemiluminescence. 135. The method of embodiment 112, wherein a fluorimeter is position directly above the incubation and detection chamber. 136. The method of embodiment 112, wherein the top surface of the incubation and detection chamber is functionalized with nucleic acid molecules conjugated with a biotin moiety. 137. The method of embodiment 112, wherein the bottom surface of the incubation and detection chamber operates as an electrode and is coated with streptavidin molecules. 138. The method of any one of embodiments 136-137, wherein the pre-complexed programmable nuclease mix with an amplified target nucleic acid flows into the incubation and detection chamber, is activated at a higher temperature, and cleaves the nucleic acid molecules conjugated with the biotin moiety. 139. The method of embodiment 138, wherein the cleaved biotin diffuses to the bottom surface and binds streptavidin, resulting in an increase in current. 140. The method of embodiment 112, wherein an electroactive mediator moiety conjugated to individual nucleotides of nucleic acid molecules (ssRNA, ssDNA or ssRNA/DNA hybrid molecules) are immobilized on the bottom surface of the incubation and detection chamber. 141. The method of embodiment 140, wherein the electroactive mediator moiety is ferrocene (Fc). 142. The method of embodiment 140, wherein the pre-complexed programmable nuclease mix with an amplified target nucleic acid flows into the incubation and detection chamber, is activated at a higher temperature, and cleaves immobilized Fc-conjugated nucleic acid molecules, resulting in a decrease in current. 143. The method of embodiment 112, wherein the incubation and detection chambers are separate. 144. The method of embodiment 143, wherein a top surface of the incubation chamber is coated with ssNA conjugated to invertase. 145. The method of embodiment 143, wherein a bottom surface of the incubation chamber comprises a thin-film planar heater. 146. The method of embodiment 143, wherein a top surface of the detection chamber comprises a camera or optical sensor. 147. The method of embodiment 143, wherein a bottom surface of the detection chamber comprises a thin-film planar heater. 148. The method of embodiment 145, wherein detection comprises optical readout using DNS or electrochemical readout with an electrochemical analyzer or glucometer. 149. The method of embodiment 144, wherein the pre-Complexed programmable nuclease mix with an amplified target nucleic acid flows into the incubation and detection chamber, is activated, and catalyzes breakdown of sucrose to fructose and glucose. 150. The method of embodiment 149, wherein the amount of fructose and glucose is linked to a colorimetric reaction. 151. The method of embodiment 149, wherein the pre-Complexed programmable nuclease mix with an amplified target nucleic acid, and glucose flows into a separate chamber wherein the separate chamber comprises glucose oxidase dried on its surface and catalyzes the oxidation of glucose to hydrogen peroxide and D-glucono-δ-lactone. 152. A system for detecting a target nucleic acid by a programmable nuclease reaction, said system comprising a fluidic device, wherein the fluidic device comprises an incubation and detection chamber. 153. The system of embodiment 152, wherein features of the fluidic device or embossed using injection molding, (2) micro-milled or micro-engraved using computer numerical control (CNC) micromachining, or non-contact laser drilling (by means of a CO2 laser source); (3) incorporated via additive manufacturing, and/or (4) incorporated via photolithographic methods. 154. The system of embodiment 152, wherein the fluidic device comprises at least three pumps. 155. The system of embodiment 152, wherein the fluidic device comprises at least three reservoirs. 156. The system of embodiment 152, wherein the fluidic device comprises up to four microvalves. 157. The system of embodiment 156, wherein the microvalves comprise electro-kinetic microvalves, pneumatic microvalves, vacuum microvalves, capillary microvalves, pinch microvalves, phase-change microvalves, or burst microvalves. 158. The system of embodiment 152, wherein the top surface of the incubation and detection chamber is functionalized with nucleic acid molecules conjugated with a biotin moiety. 159. The system of embodiment 152, wherein the bottom surface of the incubation and detection chamber operates as an electrode and is coated with streptavidin molecules. 160. The system of embodiment 152, wherein an electroactive mediator moiety conjugated to individual nucleotides of nucleic acid molecules (ssRNA, ssDNA or ssRNA/DNA hybrid molecules) are immobilized on the bottom surface of the incubation and detection chamber. 161. The system of embodiment 160, wherein the electroactive mediator moiety is ferrocene (Fc). 162. The system of embodiment 152, wherein the incubation and detection chambers are separate. 163. The system of embodiment 162, wherein a top surface of the incubation chamber is coated with ssDNA conjugated to invertase. 164. The system of embodiment 162, wherein a bottom surface of the incubation chamber comprises a thin-film planar heater. 165. The system of embodiment 162, wherein a top surface of the detection chamber comprises a camera or optical sensor. 166. The system of embodiment 162, wherein a bottom surface of the detection chamber comprises a thin-film planar heater. 167. The system of embodiment 162, wherein the fluidic device comprises a separate chamber comprising glucose oxidase dried on its surface. 168. The method of any one of embodiments 112-151, wherein the pre-complexed programmable nuclease mixture comprises a guide RNA complementary to the target nucleic acid and a Cas nuclease. 169. The method of embodiment 12, wherein the first programmable nuclease is an RNase. 170. The method of embodiment 12, wherein the first programmable nuclease is a DNase. 171. The method of embodiment 12, wherein the second programmable nuclease is a DNase. 172. The method of embodiment 12, wherein the second programmable nuclease is a RNase. 173. The method of embodiment 12, wherein the first programmable nuclease is Cas protein. 174. The method of embodiment 12, wherein the second programmable nuclease is a Cas protein. 175. The method of embodiment 12, wherein the first programmable nuclease is Cas13. 176. The method of embodiment 12, wherein the second programmable nuclease is Cas12. 177. The method of embodiment 12, wherein the second programmable nuclease is Cas14. 178. The method of embodiment 12, wherein the assaying for the pathogenic nucleic acid in the sample and the pathogen resistance locus in the sample are performed in a common reaction volume. 179. The method of embodiment 12, wherein the pathogen resistance locus is a host locus that confers host resistance to the pathogen. 180. The method of embodiment 12, wherein the pathogen resistance locus is a pathogen locus that confers resistance to disease treatment. 181. The method of embodiment 12, wherein the pathogen resistance locus is a pathogen locus that confers resistance to antibiotic treatment. 182. The method of embodiment 12, wherein cleavage of a first detector nucleic acid upon activation of the first programmable nuclease indicates a presence of a species of pathogen, and cleavage of a second detector nucleic acid upon activation of the second programmable nuclease indicates a presence of an antibiotic resistant SNP of the species of pathogen. 183. The method of embodiment 13, wherein the first programmable nuclease is an RNase. 184. The method of claim 13, wherein the first programmable nuclease is a DNase. 185. The method of embodiment 13, wherein the second programmable nuclease is a DNase. 186. The method of embodiment 13, wherein the second programmable nuclease is a RNase. 187. The method of embodiment 13, wherein the first programmable nuclease is Cas protein. 188. The method of embodiment 13, wherein the second programmable nuclease is a Cas protein. 189. The method of embodiment 13, wherein the first programmable nuclease is Cas13. 190. The method of embodiment 13, wherein the second programmable nuclease is Cas12. 191. The method of embodiment 13, wherein the second programmable nuclease is Cas14. 192. The method of embodiment 13, wherein the assaying for the pathogenic nucleic acid in the sample and the pathogen resistance locus in the sample are performed in a common reaction volume. 193. The system of embodiment 7 further comprising at least one additional guide nucleic acid selected from a group of tiled guide nucleic acid that correspond to nucleic acid of a strain of an infectious agent and wherein the guide nucleic acid and the at least one additional guide nucleic acid comprise different sequences. 194. The method of embodiment 10, wherein the detected signal is generated in no more than 15 minutes. 195. The method of embodiment 10, wherein the detected signal is generated in no more than 10 minutes. 196. The method of embodiment 10, wherein the detected signal is generated in no more than 5 minutes. 197. The method of embodiment 10, wherein the target nucleic acid is amplified before the contacting. 198. The method of embodiment 197, wherein the amplification is isothermal amplification. 199. The method of embodiment 10, wherein the sample is urine. 200. The method of embodiment 10, wherein the sample is saliva. 201. The method of embodiment 10, wherein the sample is blood. 202. The method of embodiment 14, wherein the output comprises fluorescence/second. 203. The method of embodiment 14, wherein the reaction rate log linear for output signal and target nucleic acid concentration. 204. The method of embodiment 14, wherein the signal output is correlated with the target nucleic acid concentration. 205. The method of embodiment 14, wherein the target nucleic acid is RNA. 206. The method of embodiment 14, wherein the target nucleic acid is DNA. 207. The method of embodiment 15, wherein a total time for nucleic acid detection is no greater than 60 minutes. 208. The method of embodiment 15, wherein a total time for nucleic acid detection is no great than 50 minutes. 209. The method of embodiment 15, wherein a total time for nucleic acid detection is no greater than 40 minutes. 210. The method of embodiment 15, wherein a total time for nucleic acid detection is no greater than 30 minutes. 211. The method of embodiment 15, wherein the sample is obtained from a swab. 212. The method of embodiment 15, wherein the sample is obtained from urine. 213. The method of embodiment 15, wherein the sample is obtained from blood. 214. The method of embodiment 15, wherein the sample is contained in no more than 20 µl. 215. The method of embodiment 16, wherein the first programmable nuclease and the second programmable nuclease do not cleave a common detector nucleic acid site upon activation. 216. The method of embodiment 17, wherein the disease status is cancer status. 217. The method of embodiment 17, wherein the disease status is prostate cancer status. 218. The method of embodiment 18, wherein the plurality of unique target nucleic acids are from a plurality of bacterial pathogens in the sample. 219. The method of embodiment 18, wherein the quantification of a signal of the plurality correlates with a concentration of a unique target nucleic acid of the plurality for the unique target nucleic acid of the plurality that produced the signal of the plurality. 220. The method of embodiment 19, wherein the tiled guide nucleic acids are sequentially tiled. 221. The method of embodiment 19, wherein the tiled guide nucleic acids have overlapping tiling. 222. The method of embodiment 19, wherein the tiled guide nucleic acids are non-sequentially tiled. 223. The system, kit, method, or support medium of any one of embodiments 1-222, further comprising a reporter. 224. The system, kit, method, or support medium of embodiment 223, wherein the reporter comprises a biotin. 225. The system, kit, method, or support medium of any one of embodiments 223-224, wherein the reporter comprises a methylene blue molecule. 226. The system, kit, method, or support medium of any one of embodiments 223-225, wherein cleavage of the reporter by a Cas protein results in an increase in current. 227. The system, kit, method, or support medium of any one of embodiments 223-226, wherein the reporter comprises a nucleic acid linker conjugated to biotin-dT at the 5' end, a FAM reporter at the 5' end, or a combination thereof 228. The system, kit, method, or support medium of any one of embodiments 223-227, wherein the reporter is conjugated to a substrate at the 3' end. 229. The system, kit, method, or support medium of embodiment 228, wherein the substrate comprises a reaction chamber. 230. The system, kit, method, or support medium of any one of embodiments 228-229, wherein the substrate comprises a bead. 231. The system, kit, method, or support medium of any one of embodiments 223-230, wherein the bead is a magnetic bead. 232. The system, kit, method, or support medium of any one of embodiments 223-231, wherein a signal is visualized by a nanoparticle. 233. The system, kit, method, or support medium of embodiment 232, wherein the nanoparticle comprises a gold nanoparticle. 234. The system, kit, method, or support medium of any one of embodiments 223-233, wherein the reporter is cleaved by a Cas protein in a reaction chamber upstream of a test strip to generate a cleaved reporter. 235. The system, kit, method, or support medium of any one of embodiments 223-234, wherein the test strip comprises a streptavidin at a first test line spaced downstream of the reaction chamber. 236. The system, kit, method, or support medium of embodiment 235, wherein the streptavidin binds the cleaved reporter. 237. The system, kit, method, or support medium of any one of embodiments 233-236, wherein the gold nanoparticle is coated with an anti-reporter antibody. 238. The system, kit, method, or support medium of embodiment 237, wherein the anti-reporter antibody coated gold nanoparticle binds to the cleaved reporter at the test line. 239. The system, kit, method, or support medium of any one of embodiments 223-238, wherein a flow control line is spaced downstream of the test line. 240. The system, kit, method, or support medium of any one of embodiments 223-239, wherein the flow control line comprises a control antibody, which binds the anti-reporter antibody conjugated gold nanoparticles. 241. A method of assaying for a target nucleic acid in a sample, comprising: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; and b) assaying for a signal indicating cleavage of at least some protein-nucleic acids of a population of protein-nucleic acids, wherein the signal indicates a presence of the target nucleic acid in the sample and wherein absence of the signal indicates an absence of the target nucleic acid in the sample. 242. The method of embodiment 241, wherein a protein-nucleic acid of the population of protein nucleic acids is an enzyme-nucleic acid. 243. The method of embodiment 241, wherein a protein-nucleic acid of the population of protein nucleic acids is an enzyme substrate-nucleic acid. 244. The method of embodiment 242, wherein an enzyme of the enzyme-nucleic acid is an invertase enzyme. 245. The method of embodiment 242, wherein an enzyme of the enzyme-nucleic acid is a sterically hindered enzyme. 246. The method of embodiment 245, wherein upon cleavage of a nucleic acid of the enzyme-nucleic acid, the enzyme is functional. 247. The method of embodiment 241, wherein the population of protein-nucleic acids is attached to a solid support. 248. The method of embodiment 247, wherein the solid support is a surface. 249. The method of embodiment 248, wherein the surface is an electrode. 250. The method of embodiment 247, wherein the solid support is a bead. 251. The method of embodiment 250, wherein the bead is a magnetic bead. 252. The method of embodiment 241, wherein the signal is a calorimetric signal. 253. The method of embodiment 252, wherein the calorimetric signal is heat produced after the cleavage of the at least some protein-nucleic acids. 254. The method of embodiment 252, wherein the calorimetric signal is heat absorbed after the cleavage of the at least some protein-nucleic acids. 255. The method of embodiment 241, wherein the signal is a potentiometric signal. 256. The method of embodiment 255, wherein the potentiometric signal is electric potential produced after the cleavage of the at least some protein-nucleic acids. 257. The method of embodiment 241, wherein the signal is an amperometric signal. 258. The method of embodiment 257, wherein the amperometric signal is movement of electrons produced after the cleavage of the at least some protein-nucleic acids. 259. The method of embodiment 241, wherein the signal is an optical signal. 260. The method of embodiment 259, wherein the optical signal is a colorometric signal. 261. The method of embodiment 259, wherein the optical signal is a fluorescence signal. 262. The method of embodiment 259, wherein the optical signal is a light output produced after the cleavage of the at least some protein-nucleic acids. 263. The method of embodiment 259, wherein the optical signal is a change in light absorbance between before and after the cleavage of the at least some protein-nucleic acids. 264. The method of embodiment 241, wherein the signal is a piezoelectric signal. 265. The method of embodiment 264, wherein the piezo-electric signal is a change in mass between before and after the cleavage of the at least some protein-nucleic acids. 266. The method of embodiment 241 further comprising contacting a mixture produced by step a) to an enzyme substrate of a protein of the population of protein-nucleic acids. 267. The method of embodiment 266, wherein the enzyme substrate comprises sucrose and DNS reagent. 268. The method of embodiment 241, wherein a nucleic acid of the population of protein-nucleic acids is single stranded DNA. 269. The method of embodiment 241, wherein a nucleic acid of the population of protein-nucleic acids is single stranded RNA. 270. The method of embodiment 241, wherein a nucleic acid of the population of protein-nucleic acids is a single stranded DNA/RNA hybrid. 271. The method of embodiment 241, further comprising the amplifying the target nucleic acid before step a). 272. The method of embodiment 271, wherein the amplifying comprises thermal cycling amplification. 273. The system, kit, method, or support medium of embodiment 30, wherein the amplifying comprises isothermal amplification. 274. The system, kit, method, or support medium of embodiment 273, wherein the isothermal amplification is select from the group consisting of isothermal recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), improved multiple displacement amplification (IMDA), and nucleic acid sequence-based amplification (NASBA). 275. The method of embodiment 241, wherein the programmable nuclease is a target nucleic acid activated effector protein that exhibits sequence independent cleavage upon activation. 276. The method of embodiment 241, wherein the programmable nuclease is an RNA guided nuclease. 277. The method of embodiment 241, wherein the programmable nuclease comprises a Cas nuclease. 278. The method of embodiment 277, wherein the Cas nuclease is Cas13. 279. The method of embodiment 278, wherein the Cas13 is Cas13a, Cas13b, Cas13c, Cas13d, or Cas13e. 280. The method of embodiment 277, wherein the Cas nuclease is Cas12. 281. The method of embodiment 280, wherein the Cas12 is Cas12a, Cas12b, Cas12c, Cas12d, or Cas12e. 282. The method of embodiment 277, wherein the Cas nuclease is Cas14. 283. The method of embodiment 282, wherein the Cas14 is Cas14a, Cas14b, Cas14c, Cas14d, Cas14e, Cas14f, Cas14g, or Cas14h. 284. The method of embodiment 277, wherein the Cas nuclease is Csm1, Cas9, C2c4, C2c8, C2c5, C2c10, or C2c9. 285. The method of embodiment 241, wherein the guide nucleic acid comprises a crRNA. 286. The method of embodiment 241, wherein the guide nucleic acid comprises a crRNA and a tracrRNA. 287. The method of embodiment 241, wherein the signal is present prior to protein-nucleic acid cleavage. 288. The method of embodiment 241, wherein the signal is absent prior to protein-nucleic acid cleavage. 289. The method of embodiment 241, wherein the sample comprises blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. 290. A method of assaying for a target nucleic acid in a sample, comprising: a) contacting the sample to a complex comprising a guide nucleic acid comprising a segment that is reverse complementary to a segment of the target nucleic acid and a programmable nuclease that exhibits sequence independent cleavage upon forming a complex comprising the segment of the guide nucleic acid binding to the segment of the target nucleic acid; b) contacting the complex to a substrate; c) contacting the substrate to a reagent that differentially reacts with a cleaved substrate; and d) assaying for a signal indicating cleavage of the substrate, wherein the signal indicates a presence of the target nucleic acid in the sample and wherein absence of the signal indicates an absence of the target nucleic acid in the sample. 291. The method of embodiment 290, wherein the substrate is an enzyme-nucleic acid. 292. The method of embodiment 290, wherein the substrate is an enzyme substrate-nucleic acid. 293. The method of embodiment 291, wherein an enzyme of the enzyme-nucleic acid is an invertase enzyme. 294. The method of embodiment 291, wherein an enzyme of the enzyme-nucleic acid is a sterically hindered enzyme. 295. The method of embodiment 294, wherein upon cleavage of a nucleic acid of the enzyme-nucleic acid, the enzyme is functional. 296. The method of embodiment 290, wherein the substrate is attached to a solid support. 297. The method of embodiment 296, wherein the solid support is a surface. 298. The method of embodiment 297, wherein the surface is an electrode. 299. The method of embodiment 296, wherein the solid support is a bead. 300. The method of embodiment 250, wherein the bead is a magnetic bead. 301. The method of embodiment 290, wherein the signal is a calorimetric signal. 302. The method of embodiment 301, wherein the calorimetric signal is heat produced after the cleavage of the substrate. 303. The method of embodiment 301, wherein the calorimetric signal is heat absorbed after the cleavage of the substrate. 304. The method of embodiment 290, wherein the signal is a potentiometric signal. 305. The method of embodiment 304, wherein the potentiometric signal is electric potential produced after the cleavage of the substrate. 306. The method of embodiment 290, wherein the signal is an amperometric signal. 307. The method of embodiment 306, wherein the amperometric signal is movement of electrons produced after the cleavage of the substrate. 308. The method of embodiment 290, wherein the signal is an optical signal. 309. The method of embodiment 308, wherein the optical signal is a colorimetric signal. 310. The method of embodiment 308, wherein the optical signal is a fluorescence signal. 311. The method of embodiment 308, wherein the optical signal is a light output produced after the cleavage of the substrate. 312. The method of embodiment 308, wherein the optical signal is a change in light absorbance between before and after the cleavage of the substrate. 313. The method of embodiment 290, wherein the signal is a piezo-electric signal. 314. The method of embodiment 313, wherein the piezo-electric signal is a change in mass between before and after the cleavage of the substrate. 315. The method of embodiment 291, wherein the reagent comprises an enzyme substrate. 316. The method of embodiment 292, wherein the reagent comprises an enzyme. 317. The method of embodiment 315, wherein the enzyme substrate comprises sucrose and DNS reagent. 318. The method of embodiment 290, wherein the reagent comprises a single stranded DNA. 319. The method of embodiment 290, wherein the reagent comprises a single stranded RNA. 320. The method of embodiment 290, wherein the reagent comprises a single stranded DNA/RNA hybrid. 321. The method of embodiment 290, further comprising the amplifying the target nucleic acid before step a). 322. The method of embodiment 321, wherein the amplifying comprises thermal cycling amplification. 323. The method of embodiment 321, wherein the amplifying comprises isothermal amplification. 324. The method of embodiment 323, wherein the isothermal amplification is select from the group consisting of isothermal recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), improved multiple displacement amplification (IMDA), and nucleic acid sequence-based amplification (NASBA). 325. The method of embodiment 290, wherein the programmable nuclease is a target nucleic acid activated effector protein that exhibits sequence independent cleavage upon activation. 326. The method of embodiment 290, wherein the programmable nuclease is an RNA guided nuclease. 327. The method of embodiment 290, wherein the programmable nuclease comprises a Cas nuclease. 328. The method of embodiment 327, wherein the Cas nuclease is Cas13. 329. The method of embodiment 328, wherein the Cas13 is Cas13a, Cas13b, Cas13c, Cas13d, or Cas13e. 330. The method of embodiment 327, wherein the Cas nuclease is Cas12. 331. The method of embodiment 330, wherein the Cas12 is Cas12a, Cas12b, Cas12c, Cas12d, or Cas12e. 332. The method of embodiment 327, wherein the Cas nuclease is Cas14. 333. The method of embodiment 332, wherein the Cas14 is Cas14a, Cas14b, Cas14c, Cas14d, Cas14e, Cas14f, Cas14g, or Cas14h. 334. The method of embodiment 327, wherein the Cas nuclease is Csm1, Cas9, C2c4, C2c8, C2c5, C2c10, or C2c9. 335. The method of embodiment 291, wherein the guide nucleic acid comprises a crRNA. 336. The method of embodiment 291, wherein the guide nucleic acid comprises a crRNA and a tracrRNA. 337. The method of embodiment 291, wherein the signal is present prior to substrate cleavage. 338. The method of embodiment 291, wherein the signal is absent prior to substrate acid cleavage. 339. The method of embodiment 291, wherein the sample comprises blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. 340. The method of embodiment 19, wherein the of guide nucleic acids provides broad spectrum identification of the target nucleic acid. 341. The method of embodiment 290, wherein the target nucleic acid is DNA and the programmable nuclease is Cas13. 342. The method of embodiment 341, wherein the Cas13 is Cas13a. 343. The method of embodiment 342, wherein the Cas13a is Lbu-Cas13a or Lwa-Cas13a. 344. The method of embodiment 340, wherein the target nucleic acid lacks a guanine at the 3' end. 345. The method of embodiment 341, wherein the sequence independent cleavage occurs from pH 6.8 to pH 8.2. 346. A method of assaying for a target DNA sequence in a sample, the method comprising: contacting the sample to a complex comprising a guide nucleic acid comprising a segment that is reverse complementary to a segment of the target DNA sequence and a Type VI programmable nuclease; hybridizing the segment of the guide nucleic acid to the segment of the target DNA sequence, thereby activating the Type VI programmable nuclease to cleave an RNA sequence via sequence independent cleavage. 347. The method of embodiment 346, wherein the method further comprises generating a detectable signal upon the sequence independent cleavage of the RNA sequence. 348. The method of embodiment 347, further comprising assaying for the detectable signal. 349. The method of any one of embodiments 346-348, wherein the Type VI programmable nuclease is a Cas13 programmable nuclease. 350. The method of embodiment 349, wherein the Cas13 programmable nuclease is a Cas13a programmable nuclease. 351. The method of embodiment 350, wherein the Cas13a programmable nuclease comprises Lbu-Cas13a or Lwa-Cas13a. 352. The method of any one of embodiments 346-351, wherein the sequence independent cleavage occurs from pH 6.8 to pH 8.2. 353. The method of any one of embodiments 346-351, wherein the target DNA sequence lacks a guanine at the 3' end. 354. The method of any one of embodiments 346-353, wherein the target DNA sequence is ssDNA. 355. The method of any one of embodiments 346-353, wherein the target DNA sequence is present in an organism. 356. The method of embodiment 355, wherein the organism is a virus or bacteria, 357. The method of any one of embodiments 346-353, wherein the target DNA sequence is generated by a nucleic acid amplification method. 358. The method of embodiment 357, wherein the nucleic acid amplification method comprises recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), improved multiple displacement amplification (IMDA), and nucleic acid sequence-based amplification (NASBA), or PCR. 359. The method of any one of embodiments 347-358, wherein the detectable signal is fluorescence, luminescence, colorimetric, electrochemical, enzymatic, calorimetric, optical, amperometric, or potentiometric. 360. The method of any one of embodiments 346-359, further comprising multiplexing with a complex of a second guide nucleic acid comprising a second segment that is reverse complementary to a second segment of a second target DNA sequence and a Type V programmable nuclease. 361. The method of embodiment 360, wherein the Type V programmable nuclease is Cas12. 362. The method of embodiment 361, wherein the Cas12 is Cas12 is Cas12a, Cas12b, Cas12c, Cas12d, or Cas12e. 363. The method of any one of embodiments 346-362, wherein the guide nucleic acid comprises a crRNA. 364. The method of any one of embodiments 346-363, wherein the guide nucleic acid comprises a crRNA and a tracrRNA. 365. The method of any one of embodiments 347-364, wherein the detectable signal is present prior to substrate cleavage. 366. The method of any one of embodiments 347-364, wherein the detectable signal is absent prior to substrate acid cleavage. 367. The method of any one of embodiments 346-366, wherein the sample comprises blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. 368. The method of any one of embodiments 346-367, wherein the method is carried out on a support medium. 369. The method of any one of embodiments 346-368, wherein the method is carried out on a lateral flow assay device.

The following embodiments recite permutations of combinations of features disclosed herein. In some cases, permutations of combinations of features disclosed herein are non-limiting. In other cases permutations of combinations of features disclosed herein are limiting. Other permutations of combinations of features are also contemplated. In particular, each of these numbered embodiments is contemplated as depending from or relating to every previous or subsequent numbered embodiment, independent of their order as listed. 1. A method of detecting a target nucleic acid in a sample, the method comprising: contacting a first volume to a second volume, wherein the first volume comprises the sample and the second volume comprises: a programmable nuclease; a guide nucleic acid having a portion reverse complementary to a portion of a target nucleic acid in the sample; and a reporter, wherein the second volume is at least 4-fold greater than the first volume; and detecting the presence or the absence of the target nucleic acid by measuring a signal produced by cleavage of the reporter, wherein cleavage occurs when the programmable nuclease is activated. 2. The method of any preceding embodiment, wherein the reporter is a hybrid nucleic acid reporter. 3. The method of any preceding embodiment, wherein the method further comprises amplifying the target nucleic acid. 4. A method of detecting a target nucleic acid in a sample, the method comprising: contacting the sample to: a programmable nuclease; a guide nucleic acid having a portion reverse complementary to a portion of the target nucleic acid; and a hybrid nucleic acid reporter; and assaying for a signal generated by cleavage of the hybrid nucleic acid reporter. 5. The method of any preceding embodiment, wherein the contacting comprises contacting a first volume to a second volume, wherein the first volume comprises the sample and the second volume comprises the programmable nuclease, the guide nucleic acid, and the hybrid nucleic acid reporter and wherein the second volume is at least 4-fold greater than the first volume. 6. The method of any preceding embodiment, wherein the method further comprises amplifying the target nucleic acid. 7. A method of disease detection, the method comprising: contacting a sample to a first programmable nuclease and a first guide nucleic acid having a portion reverse complementary to a portion of a first target nucleic acid from a disease causing organism; and a second programmable nuclease and a second guide nucleic acid having a portion reverse complementary to a portion of a second target nucleic acid from an antibiotic resistant locus of the disease causing organism; and assaying for: a first signal generated by cleavage of a first reporter; and a second signal generated by cleavage of a second reporter. 8. The method of any preceding embodiment, wherein the disease causing organism is *Neisseria gonorrhoeae, Acinetobacter baumannii, Staphylococcus aureus, Burkholderia cepacia, Pseudomonas aeruginosa, Escherichia coli, Mycobacterium tuberculosis, Klebsiella pneumoniae,* or *Streptococcus pyogenes.* 9. The method of any preceding embodiment, wherein the antibiotic resistant locus of the disease causing organism confers resistance to vancomycin, erythromycin, clindamycin, or any combination thereof 10. The method of any preceding embodiment, wherein the first programmable nuclease is a Type V programmable nuclease or a Type VI programmable nuclease. 11. The method of any preceding embodiment, wherein the second programmable nuclease is a Type V programmable nuclease or a Type VI programmable nuclease. 12. The method of any preceding embodiment, wherein the Type V programmable nuclease is a Cas12 or a Cas14. 13. The method of any preceding embodiment, wherein the Type VI programmable nuclease is a Cas13. 14. The method of any preceding embodiment, wherein the Cas12 is Cas12 is Cas12a, Cas12b, Cas12c, Cas12d, or Cas12e. 15. The method of any preceding embodiment, wherein the Cas14 is Cas14a, Cas14b, Cas14c, Cas14d, Cas14e, Cas14f, Cas14g, or Cas14h. 16. The method of any preceding embodiment, wherein the Cas13 is Cas13a, Cas13b, Cas13c, Cas13d, or Cas13e. 17. The method of any preceding embodiment, wherein the first reporter, the second reporter, or a combination thereof comprises a nucleic acid, an affinity molecule, a detection molecule, a quencher, or any combination thereof 18. The method of any preceding embodiment, wherein the nucleic acid of the first reporter and the nucleic acid of the second reporter are different. 19. The method of any preceding embodiment, wherein the detection molecule of the first reporter and the detection molecule of the second reporter are different. 20. The method of any preceding embodiment, wherein the sample is from a subject. 21. The method of any preceding embodiment, wherein if only the first signal appears, the method further comprises administering an antibiotic corresponding to the antibiotic resistant locus to the subject. 22. The method of any preceding embodiment, wherein if the first signal and second signal appears, the method further comprises treating with an orthogonal antibiotic to the subject. 23. A method of treating a subject, the method comprising: detecting a presence or an absence of a signal by: contacting a sample containing a target nucleic acid from the subject to: a programmable nuclease; a guide nucleic acid having a portion reverse complementary to a portion of the target nucleic acid; and a reporter; and assaying for the presence of the signal generated by cleavage of the reporter; and treating the subject. 24. The method of any preceding embodiment, wherein the treating comprises administering a therapy. 25. The method of any preceding embodiment, wherein the therapy comprises radiation, chemotherapy, antibiotics, antivirals, or antifungals. 26. The method of any preceding embodiment, wherein the administering is parenteral, topical, or local. 27. The method of any preceding embodiment, wherein the subject has a symptom of a disease. 28. The method of any preceding embodiment, wherein the subject is asymptomatic. 29. The method of any preceding embodiment, wherein the method comprises amplifying the target nucleic acid. 30. The method of any preceding embodiment, wherein the contacting comprises contacting a first volume to a second volume, wherein the first volume comprises the sample and the second volume comprises the programmable nuclease, the guide nucleic acid, and the reporter, and wherein the second volume is at least 4-fold greater than the first volume. 31. The method of any preceding embodiment, wherein the second volume is at least 4-fold greater to at least 50-fold greater than the first volume. 32. The method of any preceding embodiment, wherein the second volume is at least 10-fold greater than the first volume. 33. The method of any preceding embodiment, wherein the total nucleic acids includes the target nucleic acid and non-target nucleic acids. 34. The method of any preceding embodiment, wherein the non-target nucleic acids are from the sample. 35. The method of any preceding embodiment, wherein the non-target nucleic acids are from an amplified sample. 36. The method of any preceding embodiment, wherein the target nucleic acid comprises the forward primer, the reverse primer, ssDNA generated from amplification, or any combination thereof 37. The method of any preceding embodiment, wherein the method comprises lysing the sample. 38. The method of any preceding embodiment, wherein the reporter comprises a nucleic acid, an affinity molecule, a detection molecule, a quencher, or any combination thereof 39. The method of any preceding embodiment, wherein the nucleic acid is conjugated at one end to the affinity molecule and the detection molecule. 40. The method of any preceding embodiment, wherein the nucleic acid is a single stranded nucleic acid. 41. The method of any preceding embodiment, wherein the single stranded nucleic acid is single stranded DNA. 42. The method of any preceding embodiment, wherein the single stranded nucleic acid is single stranded RNA. 43. The method of any preceding embodiment, wherein the affinity molecule is biotin. 44. The method of any preceding embodiment, wherein the detection molecule is a fluorescent molecule, an electrochemical molecule, or an enzyme. 45. The method of any preceding embodiment, wherein the fluorescent molecule is 6-fluorescein, IRDye 700, TYE 665, Alexa Fluor 594, ATTO TM 633, or Iowa Black RQ. 46. The method of any preceding embodiment, wherein the electrochemical molecule comprises biotin, ferrocene, digoxigenin, or invertase. 47. The method of any preceding embodiment, wherein the quencher is IABkFQ or IRQC1N. 48. The method of any preceding embodiment, wherein the programmable nuclease, the reporter, the guide nucleic acid, the forward primer, the reverse primer, the deoxynucleotide triphosphate, the reverse transcriptase, the T7 promoter, the T7 polymerase, or any combination thereof are lyophilized or vitrified. 49. The method of any preceding embodiment, wherein the programmable nuclease, the reporter, the guide nucleic acid, the forward primer, the reverse primer, the deoxynucleotide triphosphate, the reverse transcriptase, the T7 promoter, the T7 polymerase, or any combination thereof are suspended in a buffer. 50. The method of any preceding embodiment, wherein the reporter is immobilized to the surface of the detection chamber 51. The method of any preceding embodiment, wherein the reporter is present at a concentration of from 10 nM to 1000 nM. 52. The method of any preceding embodiment, wherein the reporter is present at a concentration of from 100 to 500 nM of reporter. 53. The method of any preceding embodiment, wherein the forward primer, the reverse primer, the deoxynucleotide triphosphate, the reverse transcriptase, the T7 promoter, the T7 polymerase, or any combination thereof are suspended in an amplification buffer. 54. The method of any preceding embodiment, wherein the method comprises from 1 nM to 100 nM of target nucleic acids. 55. The method of any preceding embodiment, wherein the method comprises from 1 nM to 1000 nM of total nucleic acids. 56. The method of any preceding embodiment, wherein the method comprises from 10 to 25 nM of total nucleic acids. 57. The method of any preceding embodiment, wherein the method comprises a plurality of guide RNAs. 58. The method of any preceding embodiment, wherein the plurality of guide RNAs have the same sequence. 59. The method of any preceding embodiment, wherein the sequence of at least one guide RNA of the plurality of guide RNAs is unique. 60. The method of any preceding embodiment, wherein at least one guide RNAs of the plurality of guide RNAs has a portion reverse complementary to a portion of a target nucleic acid different than a second RNA of the plurality of guide RNAs. 61. The method of any preceding embodiment, wherein the plurality of guide RNAs comprise at least 20 guide RNAs. 62. The method of any preceding embodiment, wherein each of the 20 guide RNAs has a portion reverse complementary to a portion of a different target nucleic acid. 63. The method of any preceding embodiment, wherein the sample is a biological sample. 64. The method of any preceding embodiment, wherein the biological sample is blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. 65. The method of any preceding embodiment, wherein the target nucleic acid is from a virus, a fungus, a helminth, protozoa, a parasite, a malarial parasite, a *Plasmodium* parasites, a *Toxoplasma* parasites, and a *Schistosoma* parasites. 66. The method of any preceding embodiment, wherein the target nucleic acid is from influenza A virus, influenza B virus, RSV, dengue virus, West Nile virus, Hepatitis Virus C, Hepatitis Virus A, Hepatitis Virus B, papillomavirus, HIV, *chlamydia*, gonorrhea, syphilis, trichomoniasis, *borrelia*, zika virus, or a sepsis causing organism. 67. The method of any preceding embodiment, wherein the programmable nuclease is a Type V programmable nuclease. 68. The method of any preceding embodiment, wherein the Type V programmable nuclease is a Cas12. 69. The method of any preceding embodiment, wherein the Cas12 is Cas12a, Cas12b, Cas12c, Cas12d, or Cas12e. 70. The method of any preceding embodiment, wherein the programmable nuclease is a Type VI programmable nuclease. 71. The method of any preceding embodiment, wherein the Type VI programmable nuclease is a Cas13. 72. The method of any preceding embodiment, wherein the Cas13 is Cas13a, Cas13b, Cas13c, Cas13d, or Cas13e. 73. The method of any preceding embodiment, wherein the method comprises a second programmable nuclease. 74. The method of any preceding embodiment, wherein the second programmable nuclease is a Type V programmable nuclease. 75. The method of any preceding embodiment, wherein the Type V programmable nuclease is a Cas12. 76. The method of any preceding embodiment, wherein the Cas12 is Cas12a, Cas12b, Cas12c, Cas12d, or Cas12e. 77. The method of any preceding embodiment, wherein the second programmable nuclease is a Type VI programmable nuclease. 78. The method of any preceding embodiment, wherein the Type VI programmable nuclease is a Cas13. 79. The method of any preceding embodiment, wherein the Cas13 is Cas13a, Cas13b, Cas13c, Cas13d, or Cas13e. 80. The method of any preceding embodiment, wherein the programmable nuclease is a Cas14. 81. The method of any preceding embodiment, wherein the Cas14 is Cas14a, Cas14b, Cas14c, Cas14d, Cas14e, Cas14f, Cas14g, or Cas14h. 82. The method of any preceding embodiment, wherein the method is carried out in a device. 83. The method of any preceding embodiment, wherein the device comprises: a sample chamber; a detection chamber fluidically connected to the sample chamber via a pneumatic valve and comprising the programmable nuclease. 84. The method of any preceding embodiment, wherein the device comprises an amplification chamber between the sample chamber and the detection chamber. 85. The method of any preceding embodiment, wherein the amplification chamber is fluidically connected to the sample chamber and the detection chamber via pneumatic valves. 86. The method of any preceding embodiment, wherein the pneumatic valve is a PDMS pneumatic valve. 87. The method of any preceding embodiment, wherein the pneumatic valve comprises a channel perpendicular to a microfluidic channel providing the fluidic connection between the sample chamber and the detection chamber or the sample chamber and the sample chamber and the amplification chamber and the amplification chamber and the detection chamber. 88. The method of any preceding embodiment, wherein the channel perpendicular to the microfluidic channel deflects downward upon application of air pressure through the channel perpendicular to the microfluidic channel. 89. The method of any preceding embodiment, wherein lysing the sample occurs in the sample chamber for from 30 seconds to 5 minutes. 90. The method of any preceding embodiment, wherein the method further comprises opening the pneumatic valve and moving 1 to 10 ul from the sample chamber to the amplification chamber. 91. The method of any preceding embodiment, wherein the method further comprises mixing the liquid in the amplification chamber. 92. The method of any preceding embodiment, wherein the method further comprises incubating for from 10 to 30 minutes. 93. The method of any preceding embodiment, wherein the method further comprises opening the pneumatic valve and moving 1 to 10 ul from the amplification chamber to the detection chamber. 94. The method of any preceding embodiment, wherein the method further comprises mixing the liquid in the detection chamber. 95. The method of any preceding embodiment, wherein the method further comprises incubating for from 1 minute to 10 minutes. 96. The method of any preceding embodiment, wherein the assaying comprises measuring the signal with a fluorescence reader or an electrochemical reader. 97. The method of any preceding embodiment, wherein the device is made of X. 98. The method of any preceding embodiment, wherein the device comprises a sliding layer comprising a channel comprising: a channel; and a fixed layer comprising: a sample chamber; a detection chamber, wherein the detection chamber comprises a programmable nuclease. 99. The method of any preceding embodiment, wherein the fixed layer further comprises an amplification chamber. 100. The method of any preceding embodiment, wherein the sliding layer is the lower layer. 101. The method of any preceding embodiment, wherein the sliding layer is the upper layer. 102. The method of any preceding embodiment, wherein the channel, the sample chamber, the amplification chamber, the detection chamber, or any combination thereof has an opening. 103. The method of any preceding embodiment, wherein the device further comprises a first side channel with an opening aligned with the opening in the sample chamber, a second side channel with an opening aligned with the opening in the amplification chamber, a third side channel with an opening aligned with the opening in the detection chamber, or any combination thereof 104. The method of any preceding embodiment, wherein the first side channel, the second side channel, and the third side channel are fluidically connected to a mixing chamber. 105. The method of any preceding embodiment, wherein the mixing chamber comprises a pneumatic pump for mixing, aspirating, and dispensing fluid in the device. 106. The method of any preceding embodiment, wherein the sliding layer comprises a second channel. 107. The method of any preceding embodiment, wherein the second channel comprises an opening. 108. The method of any preceding embodiment, wherein the fixed layer comprises from 1 to 10 additional amplification chambers. 109. The method of any preceding embodiment, wherein the fixed layer comprises from 1 to 10 additional detection chambers. 110. The method of any preceding embodiment, wherein the upper layer is made of plastic polymers comprising poly-methacrylate (PMMA), cyclic olefin polymer (COP), cyclic olefin copolymer (COC), polyethylene (PE), high-density polyethylene (HDPE), polypropylene (PP); glass; or silicon. 111. The method of any preceding embodiment, wherein the lower layer is made of plastic polymers comprising poly-methacrylate (PMMA), cyclic olefin polymer (COP), cyclic olefin copolymer (COC), polyethylene (PE), high-density polyethylene (HDPE), polypropylene (PP); glass; or silicon. 112. The method of any preceding embodiment, wherein the method comprises one or more of the following steps: sliding the sliding layer to overlap the opening of the sample chamber with the opening of the channel; moving the sample from the sample chamber into the channel; aspirating the sample from the channel into the first side channel and mixing; sliding the sliding layer to overlap the opening of the channel with the opening of the amplification chamber; dispensing the sample into the amplification chamber; sliding the sliding layer to overlap the opening of the amplification chamber with the opening of the channel; moving the sample from the amplification chamber into the channel; aspirating the sample from the channel into the second side channel and nixing; sliding the sliding layer to overlap the opening of the channel with the opening of the detection chamber; and dispensing the sample into the detection chamber. 113. The method of any preceding embodiment, wherein the device comprises from 1 to 10 additional detection chambers. 114. The method of any preceding embodiment, wherein the device comprises from 1 to 10 additional amplification chambers. 115. The method of any preceding embodiment, wherein the detection chamber comprises a metal lead adapted for measurement of a change in current. 116. The method of any preceding embodiment, wherein the device is adjacent to a thermal heater. 117. The method of any preceding embodiment, wherein the device comprises a region with a soft polymer attached to a metal element conducting heat. 118. The method of any preceding embodiment, wherein the sample chamber holds a volume of from 100 to 1000 µL. 119. The method of any preceding embodiment, wherein the detection chamber holds a volume of from 1 to 100 µL. 120. The method of any preceding embodiment, wherein the amplification chamber holds a volume of from 1 to 100 µL. 121. The method of any preceding embodiment, wherein the device further comprises a pH balancing chamber. 122. The method of any preceding embodiment, wherein the sample chamber has an opening for insertion of a sample. 123. The method of any preceding embodiment, wherein the sample chamber, the detection chamber, the and the amplification chamber all have the same buffer. 124. The method of any preceding embodiment, wherein the device comprises a chamber comprises the programmable nuclease; and the reporter comprising a nucleic acid and a first molecule; and a lateral flow strip comprising: a first region comprising a second molecule; and a second region comprising an antibody, wherein the first region is upstream of the second region and the chamber is upstream of the lateral flow strip and wherein the first molecule binds to the second molecule. 125. The method of any preceding embodiment, wherein the reporter further comprises a fluorophore. 126. The method of any preceding embodiment, wherein the first molecule is conjugated directly to the fluorophore. 127. The method of any preceding embodiment, wherein the antibody on the second region is specific for the antibody coated on the detectable moiety. 128. The method of any preceding embodiment, wherein the reporter is suspended in a buffer. 129. The method of any preceding embodiment, wherein the buffer comprises an aqueous solution, monovalent salts, divalent salts, or any combination thereof and wherein the buffer comprises a pH of from 6 to 8. 130. The method of any preceding embodiment, wherein the chamber comprises a second reporter comprising a second nucleic acid, the first molecule, and a second fluorophore. 131. The method of any preceding embodiment, wherein the first molecule is conjugated directly to the second fluorophore. 132. The method of any preceding embodiment, wherein the lateral flow strip comprises a third region comprising a second antibody. 133. The method of any preceding embodiment, wherein the antibody binds the fluorophore and the second antibody binds the second fluorophore. 134. The method of any preceding embodiment, wherein the lateral flow strip further comprises a sample pad upstream of the first region and downstream of the chamber. 135. The method of any preceding embodiment, wherein the sample pad comprises a detectable moiety. 136. The method of any preceding embodiment, wherein the detectable moiety is a metal nanoparticle. 137. The method of any preceding embodiment, wherein the metal nanoparticle is a gold nanoparticle. 138. The method of any preceding embodiment, wherein the detectable moiety is coated in an antibody and wherein the antibody binds to the fluorophore or wherein the antibody binds to the first molecule. 139. The method of any preceding embodiment, wherein the reporter, the second reporter, or both are immobilized to a surface of the chamber. 140. The method of any preceding embodiment, wherein the first molecule comprises a biotin. 141. The method of any preceding embodiment, wherein the second molecule comprises a streptavidin. 142. The method of any preceding embodiment, wherein the reporter, the second reporter, or both further comprises a magnetic bead. 143. The method of any preceding embodiment, wherein the chamber interfaces with a magnet. 144. The method of any preceding embodiment, wherein the device is connected to a sample prep device. 145. The method of any preceding embodiment, wherein from 1 to 10 devices are connected to a sample prep device. 146. The method of any preceding embodiment, wherein the sample prep device comprises a sample chamber, an amplification chamber, or any combination thereof, upstream of the reaction chamber. 147. The method of any preceding embodiment, wherein the sample prep device comprises a sample chamber, upstream, of an amplification chamber, upstream of the reaction chamber. 148. The method of any preceding embodiment, wherein the sample chamber, the amplification chamber, the reaction chamber, and the lateral flow strip are separated from each other by a substrate. 149. The method of any preceding embodiment, wherein each chamber of the sample prep device comprises a notch preventing fluid flow. 150. The method of any preceding embodiment, wherein the sample prep device comprises a rotatable element and wherein the rotatable element controls fluid flow through each chamber. 151. The method of any preceding embodiment, wherein the sample chamber comprises a lysis buffer. 152. The method of any preceding embodiment, wherein the amplifying comprises isothermal amplification. 153. The method of any preceding embodiment, wherein the amplifying comprises recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), improved multiple displacement amplification (IMDA), or nucleic acid sequence-based amplification (NASBA). 154. The method of any preceding embodiment, wherein the forward primer, the reverse primer, or both are phosphorothioated. 155. The method of any preceding embodiment 23, wherein the method has a limit of detection of at least 0.1 aM. 156. The method of any preceding embodiment, wherein the method has a limit of detection of at least 0.1 nM. 157. The method of any preceding embodiment, wherein the method has a limit of detection of at least 1 nM. 158. The method of c1 any preceding embodiment, wherein the method has a positive predictive value of at least 75%, at least 80%, at least 85%, at least 90%, at least 92%, at least 95%, at least 97%, at least 99%, or 100%. 159. The method of any preceding embodiment, wherein the method has a negative predictive value of at least 75%, at least 80%, at least 85%, at least 90%, at least 92%, at least 95%, at least 97%, at least 99%, or 100%. 160. The method of any preceding embodiment, wherein the method further comprises adding an exonuclease to the sample. 161. The method of any preceding embodiment, wherein the device comprises more than one detection chambers each fluidically connected to one amplification chamber. 162. The method of any preceding embodiment, wherein the device comprises more than one detection chambers each fluidically connected to one sample chamber. 163. A device comprising: a sample chamber; a detection chamber fluidically connected to the sample chamber via a pneumatic valve and comprising a programmable nuclease. 164. The device of any preceding embodiment, wherein the device comprises an amplification chamber between the sample chamber and the detection chamber. 165. The device of any preceding embodiment, wherein the amplification chamber is fluidically connected to the sample chamber and the detection chamber via pneumatic valves. 166. A device comprising: a sample chamber; an amplification chamber fluidically connected to the sample chamber via a first pneumatic valve; and a detection chamber fluidically connected to the amplification chamber via a second pneumatic valve and comprising a programmable nuclease. 167. The device of any preceding embodiment, wherein the pneumatic valve is a polydimethylphenylsiloxane (PDMS) pneumatic valve, a urethane rubber pneumatic valve, or a silicon rubber pneumatic valve. 168. The device of any preceding embodiment, wherein the pneumatic valve comprises a channel perpendicular to a microfluidic channel providing the fluidic connection between the sample chamber and the detection chamber or the sample chamber and the sample chamber and the amplification chamber and the amplification chamber and the detection chamber. 169. The device of any preceding embodiment, wherein the channel perpendicular to the microfluidic channel deflects downward upon application of positive or negative air pressure and through the channel perpendicular to the microfluidic channel. 170. A device comprising: a lower sliding layer comprising a channel comprising: a first channel; and a second channel; and an upper fixed layer comprising: a sample chamber; a detection chamber, wherein the detection chamber comprises a programmable nuclease. 171. The device of any preceding embodiment, wherein the fixed layer further comprises an amplification chamber. 172. A device comprising: a sliding layer comprising a channel comprising: a channel; and a fixed layer comprising: a sample chamber; an amplification chamber; and a detection chamber, wherein the detection chamber comprises a programmable nuclease. 173. The device of any preceding embodiment, wherein the sliding layer is the lower layer. 174. The device of any preceding embodiment, wherein the sliding layer is the upper layer. 175. The device of any preceding embodiment, wherein the fixed layer is the lower layer. 176. The device of any preceding embodiment, wherein the fixed layer is the upper layer. 177. The device of any preceding embodiment, wherein the channel, the sample chamber, the amplification chamber, the detection chamber, or any combination thereof has an opening. 178. The device of any preceding embodiment, wherein the device further comprises a first side channel with an opening aligned with the opening in the sample chamber, a second side channel with an opening aligned with the opening in the amplification chamber, a third side channel with an opening aligned with the opening in the detection chamber, or any combination thereof 179. The device of any preceding embodiment, wherein the first side channel, the second side channel, and the third side channel are fluidically connected to a mixing chamber. 180. The device of any preceding embodiment, wherein the mixing chamber comprises a pneumatic pump for mixing, aspirating, and dispensing fluid in the device. 181. The device of any preceding embodiment, wherein the sliding layer comprises a second channel. 182. The device of any preceding embodiment, wherein the second channel comprises an opening. 183. The device of any preceding embodiment, wherein the fixed layer comprises from 1 to 10 additional amplification chambers. 184. The device of any preceding embodiment, wherein the fixed layer comprises from 1 to 10 additional detection chambers. 185. The device of any preceding embodiment, wherein the upper layer is made of a plastic polymer comprising poly-methacrylate (PMMA), cyclic olefin polymer (COP), cyclic olefin copolymer (COC), polyethylene (PE), high-density polyethylene (HDPE), polypropylene (PP); a glass; or a silicon. 186. The device of any preceding embodiment, wherein the lower layer is made of a plastic polymer comprising poly-methacrylate (PMMA), cyclic olefin polymer (COP), cyclic olefin copolymer (COC), polyethylene (PE), high-density polyethylene (HDPE), polypropylene (PP); a glass; or a silicon. 187. The device of any preceding embodiment, wherein the detection chamber comprises a reporter and a guide nucleic acid with a portion reverse complementary to a portion of a target nucleic acid. 188. The device of any preceding embodiment, wherein the reporter comprises a nucleic acid, an affinity molecule, a detection molecule, a quencher, or any combination thereof 189. The device of any preceding embodiment, wherein the nucleic acid is conjugated at one end to the affinity molecule and the detection molecule. 190. The device of any preceding embodiment, wherein the affinity molecule is biotin, glutathione, maltose, or chitin. 191. The device of any preceding embodiment, wherein the detection molecule is a fluorescent molecule. An electrochemical molecule, or an enzyme comprising horseradish peroxidase aHRP) or alkaline phosphatase (AP). 192. The device of any preceding embodiment, wherein the fluorescent molecule is 6-fluorescein, IRDye 700, TYE 665, Alexa Fluor 594, ATTO TM 633, or Iowa Black RQ. 193. The device of any preceding embodiment, wherein the electrochemical molecule comprises biotin, ferrocene, or invertase. 194. The device of any preceding embodiment, wherein the quencher is IABkFQ or IRQC1N. 195. The device of any preceding embodiment, wherein the reporter is immobilized to the surface of the detection chamber. 196. The device of any preceding embodiment, wherein the reporter is suspended in solution in the detection chamber. 197. The device of any preceding embodiment, wherein the amplification chamber comprises reagents comprising a deoxynucleotide triphosphate, a forward primer, a reverse primer, a reverse transcriptase, a T7 promoter, a T7 polymerase, UVSX (UVSY), a nuclease, a ribonuclease, or any combination thereof 198. The device any preceding embodiment, wherein the sample chamber comprises a lysis buffer. 199. The device of any preceding embodiment, wherein the reagents are lyophilized or vitrified. 200. The device of any preceding embodiment, wherein the reagents are suspended in a buffer. 201. The device of any preceding embodiment, wherein the programmable nuclease is lyophilized or vitrified. 202. The device of any preceding embodiment, wherein the programmable nuclease is suspended in a buffer. 203. The device of any preceding embodiment, wherein the reporter and the guide nucleic acid are lyophilized or vitrified. 204. The device of any preceding embodiment, wherein the reporter and the guide nucleic acid are suspended in a buffer. 205. The device of any preceding embodiment, wherein the buffer is a lysis buffer or an amplification buffer. 206. The device of any preceding embodiment, wherein the device is connected to a pipette pump for aspirating, dispensing, and mixing fluids in the device. 207. The device of any preceding embodiment, wherein the device is made of a plastic polymer comprising poly-methacrylate (PMMA), cyclic olefin polymer (COP), cyclic olefin copolymer (COC), polyethylene (PE), high-density polyethylene (HDPE), polypropylene (PP); a glass; or a silicon. 208. The device of any preceding embodiment, wherein the device comprises from 1 to 10 additional detection chambers. 209. The device of any preceding embodiment, wherein the detection chamber or at least one detection chamber of the additional detection chambers comprises a unique guide RNA with a portion reverse complementary to a portion of a target nucleic acid. 210. The device of any preceding embodiment, wherein the device comprises from 1 to 10 additional amplification chambers. 211. The device of any preceding embodiment, wherein the detection chamber is optically connected to a fluorescence measurement device. 212. The device of any preceding embodiment, wherein the detection chamber comprises a metal lead adapted for measurement of a change in current. 213. The device of any preceding embodiment, wherein the metal lead is connected to an electrochemical measurement device. 214. The device of any preceding embodiment, wherein the device is adjacent to a thermal heater. 215. The device of any preceding embodiment, wherein the device comprises a region with a soft polymer attached to a metal element conducting heat. 216. The device of any preceding embodiment, wherein the sample chamber holds a volume of from 100 to 1000 µL. 217. The device of any preceding embodiment, wherein the detection chamber holds a volume of from 1 to 100 µL. 218. The device of any preceding embodiment, wherein the amplification chamber holds a volume of from 1 to 100 µL. 219. The device of any preceding embodiment, wherein the device further comprises a pH balancing chamber. 220. The device of any preceding embodiment, wherein the detection chamber comprises from 1 nM to 100 nM of target nucleic acids. 221. The device of any preceding embodiment, wherein the detection chamber comprises from 1 nM to 1000 nM of total nucleic acids. 222. The device of any preceding embodiment, wherein the detection chamber comprises from 10 to 25 nM of target nucleic acids. 223. The device of any preceding embodiment, wherein the detection chamber comprises from 10 nM to 1000 nM of reporter. 224. The device of any preceding embodiment, wherein the detection chamber comprises from 100 to 500 nM of reporter. 225. The device of any preceding embodiment, wherein the detection chamber comprises a plurality of guide RNAs. 226. The device of any preceding embodiment, wherein the plurality of guide RNAs have the same sequence. 227. The device of any preceding embodiment, wherein the sequence of at least one guide RNA of the plurality of guide RNAs is unique. 228. The device of any preceding embodiment, wherein at least one guide RNAs of the plurality of guide RNAs has a portion reverse complementary to a portion of a target nucleic acid different than a second RNA of the plurality of guide RNAs. 229. The device of any preceding embodiment, wherein the plurality of guide RNAs comprise at least 20 guide RNAs. 230. The device of any preceding embodiment, wherein each of the 20 guide RNAs has a portion reverse complementary to a portion of a different target nucleic acid. 231. The device of any preceding embodiment, wherein the sample chamber has an opening for insertion of a sample. 232. The device of any preceding embodiment, wherein the sample chamber, the detection chamber, the and the amplification chamber all have the same buffer. 233. A device comprising: a chamber comprising a programmable nuclease; and a reporter comprising a nucleic acid and a first molecule; and a lateral flow strip comprising: a first region comprising a second molecule; and a second region comprising an antibody, wherein the first region is upstream of the second region and the chamber is upstream of the lateral flow strip and wherein the first molecule binds to the second molecule. 234. The device of any preceding embodiment, wherein the reporter further comprises a fluorophore. 235. The device of any preceding embodiment, wherein the first molecule is conjugated directly to the fluorophore. 236. The device of any preceding embodiment, wherein the antibody on the second region is specific for the antibody coated on the detectable moiety. 237. The device of any preceding embodiment, wherein the reporter is suspended in a buffer. 238. The device of any preceding embodiment, wherein the buffer is comprises an aqueous solution, monovalent salts, divalent salts, or any combination thereof and wherein the buffer comprises a pH of from 6 to 8. 239. The device of any preceding embodiment, wherein the chamber comprises a second reporter comprising a second nucleic acid, the first molecule, and a second fluorophore. 240. The device of any preceding embodiment, wherein the first molecule is conjugated directly to the second fluorophore. 241. The device of any preceding embodiment, wherein the lateral flow strip comprises a third region comprising a second antibody. 242. The device of any preceding embodiment, wherein the antibody binds the fluorophore and the second antibody binds the second fluorophore. 243. The device of any preceding embodiment, wherein the lateral flow strip further comprises a sample pad upstream of the first region and downstream of the detection chamber. 244. The device of any preceding embodiment, wherein the sample pad comprises a detectable moiety. 245. The device of any preceding embodiment, wherein the detectable moiety is a nanoparticle. 246. The device of any preceding embodiment, wherein the nanoparticle is a metal nanoparticle, a gold nanoparticle, a silica particle, a silica-coated paramagnetic particle, a fluorescent particle, or any combination thereof 247. The device of any preceding embodiment, wherein the detectable moiety is coated in an antibody and wherein the antibody binds to the fluorophore or wherein the antibody binds to the first molecule. 248. The device of any preceding embodiment, wherein the reporter, the second reporter, or both are immobilized to a surface of the chamber. 249. The device of any preceding embodiment, wherein the first molecule comprises a biotin, glutathione, maltose, chitin, or any combination thereof 250. The device of any preceding embodiment, wherein the second molecule comprises a streptavidin, glutathione-S-transferase, maltose-binding protein, chitin-binding protein, or any combination thereof 251. The device of any preceding embodiment, wherein the reporter comprises 6-fluorescein or digoxigenin. 252. The device of any preceding embodiment, wherein the second reporter comprises 6-fluorescein or digoxigenin. 253. The device of any preceding embodiment, wherein the reporter, the second reporter, or both further comprises a quencher. 254. The device of any preceding embodiment, wherein the quencher is IABkFQ or IRQC1N. 255. The device of any preceding embodiment, wherein the reporter, the second reporter, or both further comprises a magnetic bead. 256. The device of any preceding embodiment, wherein the chamber interfaces with a magnet. 257. The device of any preceding embodiment, wherein the device is connected to a sample prep device. 258. The device of any preceding embodiment, wherein from 1 to 10 devices are connected to a sample prep device. 259. The device of any preceding embodiment, wherein the sample prep device comprises a sample chamber, an amplification chamber, or any combination thereof, upstream of the reaction chamber. 260. The device of any preceding embodiment, wherein the sample prep device comprises a sample chamber, upstream, of an amplification chamber, upstream of the reaction chamber. 261. The device of any preceding embodiment, wherein the sample chamber, the amplification chamber, the reaction chamber, and the lateral flow strip are separated from each other by a substrate. 262. The device of any preceding embodiment, wherein each chamber of the sample prep device comprises a notch preventing fluid flow. 263. The device of any preceding embodiment, wherein the sample prep device comprises a rotatable element and wherein the rotatable element controls fluid flow through each chamber. 264. The device of any preceding embodiment, wherein the sample chamber comprises a lysis buffer. 265. The device of any preceding embodiment, wherein the sample chamber comprises a biological sample. 266. The device of any preceding embodiment, wherein the biological sample comprises a target nucleic acid. 267. The device of any preceding embodiment, wherein the biological sample is blood, serum, plasma, saliva, urine, mucosal sample, peritoneal sample, cerebrospinal fluid, gastric secretions, nasal secretions, sputum, pharyngeal exudates, urethral or vaginal secretions, an exudate, an effusion, or tissue. 268. The device of any preceding embodiment, wherein the target nucleic acid is from a virus, a fungus, a helminth, protozoa, a parasite, a malarial parasite, a *Plasmodium* parasites, a *Toxoplasma* parasites, and a *Schistosoma* parasites. 269. The device of any preceding embodiment, wherein the target nucleic acid is from influenza A virus, influenza B virus, RSV, dengue virus, West Nile virus, Hepatitis Virus C, Hepatitis Virus A, Hepatitis Virus B, papillomavirus, HIV, *chlamydia*, gonorrhea, syphilis, trichomoniasis, *borrelia*, zika virus, or a sepsis causing organism. 270. The device of any preceding embodiment, wherein the programmable nuclease is a Type V programmable nuclease. 271. The device of any preceding embodiment, wherein the Type V programmable nuclease is a Cas12. 272. The device of any preceding embodiment, wherein the Cas12 is Cas12a, Cas12b, Cas12c, Cas12d, or Cas12e. 273. The device of any preceding embodiment, wherein the programmable nuclease is a Type VI programmable nuclease. 274. The device of any preceding embodiment, wherein the Type VI programmable nuclease is a Cas13. 275. The device of any preceding embodiment, wherein the Cas13 is Cas13a, Cas13b, Cas13c, Cas13d, or Cas13e. 276. The device of any preceding embodiment, wherein the detection chamber comprises a second programmable nuclease. 277. The device of any preceding embodiment, wherein the chamber comprises a second programmable nuclease. 278. The device of any preceding embodiment, wherein the second programmable nuclease is a Type V programmable nuclease. 279. The device of any preceding embodiment, wherein the Type V programmable nuclease is a Cas12. 280. The device of any preceding embodiment, wherein the Cas12 is Cas12a, Cas12b, Cas12c, Cas12d, or Cas12e. 281. The device of any preceding embodiment, wherein the second programmable nuclease is a Type VI programmable nuclease. 282. The device of any preceding embodiment, wherein the Type VI programmable nuclease is a Cas13. 283. The device of any preceding embodiment wherein the Cas13 is Cas13a, Cas13b, Cas13c, Cas13d, or Cas13e. 284. The device of any preceding embodiment, wherein the programmable nuclease is a Cas14. 285. The device of any preceding embodiment, wherein the Cas14 is Cas14a, Cas14b, Cas14c, Cas14d, Cas14e, Cas14f, Cas14g, or Cas14h. 286. The device of any preceding embodiment, wherein the nucleic acid is a single stranded nucleic acid. 287. The device of any preceding embodiment, wherein the single stranded nucleic acid is single stranded DNA. 288. The device of any preceding embodiment, wherein the single stranded nucleic acid is single stranded RNA. 289. The device of any preceding embodiment, wherein the device comprises more than one detection chambers each fluidically connected to one amplification chamber. 290. The device of any preceding embodiment, wherein the device comprises more than one detection chambers each fluidically connected to one sample chamber. 291. The device of any preceding embodiment, wherein the detection chamber comprises a plurality of guide nucleic acids, wherein the plurality of guide nucleic acids target at least 20 different target nucleic acids. 292. The device of any preceding embodiment, wherein the device comprises at least 20 detection chambers.

The following embodiments recite permutations of combinations of features disclosed herein. In some cases, permutations of combinations of features disclosed herein are non-limiting. In other cases permutations of combinations of features disclosed herein are limiting. Other permutations of combinations of features are also contemplated. In particular, each of these numbered embodiments is contemplated as depending from or relating to every previous or subsequent numbered embodiment, independent of their order as listed. 1. A device for measuring a signal comprising: i) a first chamber comprising a sample and a buffer for lysing the sample; ii) a second chamber, fluidically connected by a first pneumatic valve to the first chamber, wherein the second chamber comprises a programmable nuclease and a reporter comprising a nucleic acid and a detection moiety, and wherein the second chamber is coupled to a measurement device for measuring the signal from the detection moiety produced by cleavage of the nucleic acid of the reporter. 2. The device of claim 1, wherein the device further comprises: iii) a third chamber fluidically connected by the first pneumatic valve to the first chamber and connected by a second pneumatic valve to the second chamber. 3. The device of claim 1, wherein the first pneumatic valve fluidically connecting the first chamber and the second chamber comprises a first channel adjacent to a first microfluidic channel connecting the first chamber and the second chamber. 4. The device of claim 2, wherein the first pneumatic valve fluidically connecting the first chamber and the third chamber comprises a second channel adjacent to a second microfluidic channel connecting the first chamber and the third chamber. 5. The device of claim 2, wherein the second pneumatic valve fluidically connecting the second chamber and the third chamber comprises a third channel adjacent to a third microfluidic channel connecting the second chamber and the third chamber. 6. The device of any one of claims 2-5, wherein the first channel, the second channel, or the third channels are connected to an air manifold. 7. The device of any one of claims 1-6, wherein more than one chamber comprising a programmable nuclease and a reporter are fluidically connected to a single chamber comprising the sample. 8. The device of any one of claims 1-7, wherein more than one chamber comprising a programmable nuclease and a reporter are fluidically connected to a single chamber comprising a forward primer, a reverse primer, a dNTP, and a polymerase. 9. A device for measuring a signal comprising: a sliding layer comprising a channel with an opening at a first end of the channel and an opening at a second end of the channel; and a fixed layer comprising: i) a first chamber having an opening; ii) a second chamber having an opening, wherein the second chamber comprises a programmable nuclease and a reporter comprising a nucleic acid and a detection moiety; iii) a first side channel having an opening aligned with the opening of the first chamber; and iv) a second side channel having an opening aligned with the opening of the second chamber, wherein the sliding layer and the fixed layer move relative to each other to fluidically connect the first chamber and the first side channel via the opening at the first end of the channel, the opening at the second end of the channel, the opening of the first chamber, and the opening of the first side channel, and wherein the sliding layer and the fixed layer move relative to each other to fluidically connect the second chamber and the second side channel via the opening at the first end of the channel, the opening at the second end of the channel, the opening of the second chamber, and the opening of the second side channel. 10. The device of claim 9, wherein the fixed layer further comprises i) a third chamber having an opening; and. ii) a third side channel having an opening aligned with the opening of the third chamber, wherein the sliding layer and the fixed layer move relative to each other to fluidically connect the third chamber and the third side channel via the opening at the first end of the channel, the opening at the second end of the channel, the opening of the third chamber, and the opening of the third side channel. 11. The device of any one of claims 9-10, wherein the second chamber is coupled to a measurement device for measuring the signal from the detection moiety produced by cleavage of the nucleic acid of the reporter. 12. The device of any one of claims 9-11, wherein the opening of the first end of the channel overlaps with the opening of the first chamber and the opening of the second end of the channel overlaps with the opening of the first side channel. 13. The device of any one of claims 9-12, wherein the opening of the first end of the channel overlaps with the opening of the second chamber and the opening of the second end of the channel overlaps with the opening of the second side channel. 14. The device of any one of claims 10-13, wherein the opening of the first end of the channel overlaps with the opening of the third chamber and the opening of the second end of the channel overlaps with the opening of the third channel. 15. The device of any one of claims 9-14, wherein the first side channel, the second side channel, and the third side channel are fluidically connected to a mixing chamber. 16. The device of any one of claim 2-8 or 10-15, wherein the third chamber comprises a forward primer, a reverse primer, a dNTP, an NTP, a polymerase, a reverse transcriptase, a T7 polymerase, or any combination thereof 17. The device of claim 16, wherein the forward primer, the reverse primer, or both comprises a T7 promoter. 18. The device of any one of claims 1-17, wherein the second chamber comprises a guide nucleic acid. 19. The device of any one of claims 1-18, wherein the programmable nuclease, the reporter, the guide nucleic acid, the forward primer, the reverse primer, the dNTP, the NTP, the polymerase, the reverse transcriptase, the T7 promoter, the T7 polymerase, or any combination thereof is lyophilized or vitrified. 20. The device of any one of claims 1-19, wherein the second chamber is optically connected to a spectrophotometric measurement device or a fluorescence measurement device. 21. The device of any one of claims 1-19, wherein the second chamber comprises a metal lead adapted for measurement of a change in current. 22. The device of any one of claims 1-21, wherein the first chamber holds a volume of about 200 µL, the second chamber holds a volume of about 20 µL, and the third chamber holds a volume of about 20 µL. 23. The device of any one of claims 1-22, wherein the second chamber comprises a plurality of guide RNAs. 24. The device of any one of claims 1-23, wherein the device comprises from 2 to 20 chambers comprising a programmable nuclease, a guide nucleic acid, and a reporter, wherein a detection chamber of the from 2 to 20 chambers comprises a unique guide nucleic acid. 25. The device of any one of claims 1-24, wherein the reporter is a hybrid reporter having at least one ribonucleotide and at least one deoxyribonucleotide. 26. The device of any one of claim 1-25, wherein the reporter is immobilized to a surface. 27. The device of claim 26, wherein the surface is a surface of the first chamber or a surface of a bead. 28. A device comprising: a chamber comprising i) a programmable nuclease; and ii) an immobilized reporter comprising a nucleic acid, an affinity molecule, and a detection moiety; and a lateral flow strip comprising: i) a first region comprising a capture molecule specific for the affinity molecule; and ii) a second region comprising an antibody, wherein the first region is upstream of the second region and the chamber is upstream of the lateral flow strip and wherein the first molecule binds to the second molecule. 29. The device of claim 28, wherein the first molecule is conjugated to a 3' end or a 5' end of the nucleic acid, and wherein the first molecule is directly conjugated to the detection moiety. 30. The device of any one of claims 28-29, wherein the detection moiety comprises a fluorophore. 31. The device of any one of claims 28-30, wherein the antibody on the second region is specific for an antibody-coated nanoparticle. 32. The device of claim 31, wherein the antibody-coated nanoparticle binds the fluorophore. 33. The device of any one of claims 28-32, wherein the chamber further comprises a second immobilized reporter comprising a second nucleic acid, a second detection moiety, and the first molecule. 34. The device of claim 33, wherein the first molecule is conjugated to a 3' end or a 5' end of the second nucleic acid, and wherein the first molecule is directly conjugated to the second detection moiety. 35. The device of any one of claims 28-34, wherein the lateral flow strip comprises a third region comprising a second antibody. 36. The device of claim 35, wherein the antibody binds the fluorophore and the second antibody binds the second fluorophore. 37. The device of any one of claims 28-36, wherein the immobilized reporter, the second immobilized reporter, or both are conjugated to a magnetic bead. 38. The device of any one of claims 28-37, wherein the chamber interfaces with a magnet. 39. The device of any one of claims 28-38, wherein the device is connected to a sample prep device comprising a sample chamber, upstream, of an amplification chamber, upstream of the chamber. 40. The device of claim 39, wherein the sample chamber, the amplification chamber, the reaction chamber, and the lateral flow strip are separated by a substrate. 41. The device of any one of claims 39-40, wherein each chamber of the sample prep device comprises a notch preventing fluid flow. 42. The device of any one of claims 39-41, wherein the sample prep device comprises a rotatable element and wherein the rotatable element controls fluid flow between chambers. 43. A method of detecting a presence or an absence of a target nucleic acid in a sample, the method comprising: contacting a first volume to a second volume, wherein the first volume comprises the sample and the second volume comprises: i) a guide nucleic acid having at least 10 nucleotides reverse complementary to a target nucleic acid in the sample; and ii) a programmable nuclease activated upon binding of the guide nucleic acid to the target nucleic acid; iii) a reporter comprising a nucleic acid and a detection moiety, wherein the second volume is at least 4-fold greater than the first volume; and detecting the presence or the absence of the target nucleic acid by measuring a signal produced by cleavage of the nucleic acid of the reporter, wherein cleavage occurs when the programmable nuclease is activated. 44. The device of any one of claims 1-42 for use in a method of detecting a presence of an absence of a target nucleic acid in a sample, the method comprising: contacting a first volume to a second volume, wherein the first volume comprises the sample and the second volume comprises: i) a guide nucleic acid having at least 10 nucleotides reverse complementary to a target nucleic acid in the sample; and ii) a programmable nuclease activated upon binding of the guide nucleic acid to the target nucleic acid; iii) a reporter comprising a nucleic acid and a detection moiety, wherein the second volume is at least 4-fold greater than the first volume; and detecting the presence or the absence of the target nucleic acid by measuring a signal produced by cleavage of the nucleic acid of the reporter, wherein cleavage occurs when the programmable nuclease is activated. 45. A method comprising of detecting a presence of an absence of a first target nucleic acid, a second target nucleic acid, or both in a sample, the method comprising: contacting the sample to i) a first guide nucleic acid having at least 10 nucleotides reverse complementary to the first target nucleic acid from an organism and a first programmable nuclease activated upon binding of the first guide nucleic acid to the first target nucleic acid; and ii) a second guide nucleic acid having at least 10 nucleotides reverse complementary to the second target nucleic acid from a drug resistant allele of the organism and a second programmable nuclease activated upon binding of the second guide nucleic acid to the second target nucleic acid, wherein the first programmable nuclease and the second programmable nuclease are different; detecting a presence or an absence of the first target nucleic acid by measuring a first signal produced by cleavage of a nucleic acid of a first reporter, wherein cleavage occurs when the first programmable nuclease is activated; and detecting a presence or an absence of the second target nucleic acid by measuring a second signal produced by cleavage of a nucleic acid of the second reporter, wherein cleavage occurs when the second programmable nuclease is activated. 46. The device of any one of claims 1-42 for use in a method of detecting a presence of an absence of a first target nucleic acid, a second target nucleic acid, or both in a sample, the method comprising: contacting the sample to i) a first guide nucleic acid having at least 10 nucleotides reverse complementary to the first target nucleic acid from an organism and a first programmable nuclease activated upon binding of the first guide nucleic acid to the first target nucleic acid; and ii) a second guide nucleic acid having at least 10 nucleotides reverse complementary to the second target nucleic acid from a drug resistant allele of the organism and a second programmable nuclease activated upon binding of the second guide nucleic acid to the second target nucleic acid, wherein the first programmable nuclease and the second programmable nuclease are different; detecting a presence or an absence of the first target nucleic acid by measuring a first signal produced by cleavage of a nucleic acid of a first reporter, wherein cleavage occurs when the first programmable nuclease is activated; and detecting a presence or an absence of the second target nucleic acid by measuring a second signal produced by cleavage of a nucleic acid of the second reporter, wherein cleavage occurs when the second programmable nuclease is activated 47. The method of any one of claims 45-46, wherein the first target nucleic acid and the second target nucleic acid are different. 48. The method of any one of claims 45-47, wherein the nucleic acid of the first reporter is a DNA nucleic acid and wherein the nucleic acid of the second reporter is an RNA nucleic acid. 49. A method of detecting a target nucleic acid in a sample, the method comprising: contacting the sample to: i) a guide nucleic acid having at least 10 nucleotides reverse complementary to the target nucleic acid; and ii) a programmable nuclease activated upon binding of the guide nucleic acid to the target nucleic acid; iii) a hybrid reporter comprising a detection moiety and a nucleic acid having at least one ribonucleotide and at least one deoxyribonucleotide; detecting a presence or an absence of the target nucleic acid by measuring a signal produced by cleavage of the nucleic acid of the hybrid reporter, wherein cleavage occurs when the programmable nuclease is activated. 50. The device of any one of claims 1-42 for use in a method of detecting a target nucleic acid in a sample, the method comprising: contacting the sample to: i) a guide nucleic acid having at least 10 nucleotides reverse complementary to the target nucleic acid; and ii) a programmable nuclease activated upon binding of the guide nucleic acid to the target nucleic acid; iii) a hybrid reporter comprising a detection moiety and a nucleic acid having at least one ribonucleotide and at least one deoxyribonucleotide; detecting a presence or an absence of the target nucleic acid by measuring a signal produced by cleavage of the nucleic acid of the hybrid reporter, wherein cleavage occurs when the programmable nuclease is activated. 51. A method for identifying a treatment for a subject comprising: measuring a signal by: contacting a sample comprising a target nucleic acid from the subject to: i) a guide nucleic acid having at least 10 nucleotides reverse complementary to the target nucleic acid; and ii) a programmable nuclease activated upon binding of the guide nucleic acid to the target nucleic acid; iii) a reporter comprising a nucleic acid and a detection moiety; and measuring the signal produced by cleavage of the nucleic acid of the reporter, wherein cleavage occurs when the programmable nuclease is activated; and identifying the treatment to administer to the subject. 52. The device of any one of claims 1-42 for use in a method for identifying a treatment for a subject comprising: measuring a signal by: contacting a sample comprising a target nucleic acid from the subject to: i) a guide nucleic acid having at least 10 nucleotides reverse complementary to the target nucleic acid; and ii) a programmable nuclease activated upon binding of the guide nucleic acid to the target nucleic acid; iii) a reporter comprising a nucleic acid and a detection moiety; and measuring the signal produced by cleavage of the nucleic acid of the reporter, wherein cleavage occurs when the programmable nuclease is activated; and identifying the treatment to administer to the subject 53. The method of any one of claims 45-52, wherein the sample is in a first volume and wherein the guide nucleic acid, the programmable nuclease, and the reporter are in a second volume. 54. The method of claim 53, wherein the second volume is at least 4-fold greater than the first volume. 55. The method of any one of claim 43-44 or 53-54, wherein the second volume is at least 10-fold greater than the first volume. 56. The method of any one of claim 43-48 or 51-55, wherein the reporter is a hybrid reporter having at least one ribonucleotide and at least one deoxyribonucleotide. 57. The method of any one of claims 43-56, wherein the method comprises amplifying the target nucleic acid, reverse transcribing the target nucleic acid, in vitro transcription of the target nucleic acid, or any combination thereof 58. The method of claim 57, wherein the amplifying comprises using a phosphorothioated forward primer, a phosphorothioated reverse primer, or both. 59. The method of any one of claims 57-58, wherein the amplifying comprises isothermal amplification. 60. The method of any one of claims 57-58, wherein the amplifying comprises thermal amplification. 61. The method of any one of claims 57-58, wherein the amplifying comprises recombinase polymerase amplification (RPA), transcription mediated amplification (TMA), strand displacement amplification (SDA), helicase dependent amplification (HDA), loop mediated amplification (LAMP), rolling circle amplification (RCA), single primer isothermal amplification (SPIA), ligase chain reaction (LCR), simple method amplifying RNA targets (SMART), or improved multiple displacement amplification (IMDA), or nucleic acid sequence-based amplification (NASBA). 62. The method of claim 61, wherein the amplifying comprises recombinase polymerase amplification (RPA). 63. The method of claim 61, wherein the amplifying comprises loop mediated amplification (LAMP). 64. The method of any one of claims 57-63, wherein the amplifying the target nucleic acid, the reverse transcribing the target nucleic acid, the in vitro transcription of the target nucleic acid, or any combination thereof is in the same reaction as the detecting and the measuring. 65. The method of any one of claims 43-64, wherein the method further comprises removing non-target nucleic acids with an exonuclease. 66. The method of any one of claims 43-65, wherein the nucleic acid of the reporter is conjugated at its 3' end or 5' end to an affinity molecule, wherein the affinity molecule is directly conjugated to the detection moiety. 67. The method of any one of claims 43-66, wherein the guide nucleic acid, the programmable nuclease, and the reporter are present in a single chamber. 68. The method of claim 67, wherein the single chamber is fluidically connected to a second chamber via a first pneumatic valve, wherein the second chamber comprises the sample. 69. The method of claim 68, wherein a third chamber is positioned between the second chamber and the single chamber, wherein the third chamber comprises a dNTP, a forward primer, a reverse primer, and a polymerase. 70. The method of claim 69, wherein the third chamber is fluidically connected to the single chamber via a second pneumatic valve and wherein the third chamber is fluidically connected to the second chamber via a third pneumatic valve. 71. The method of any one of claims 69-70, wherein the method further comprises: opening the third pneumatic valve and moving 1 to 10 µL of the sample from the second chamber to the third chamber; and opening the second pneumatic valve and moving 1 to 10 µL of the sample from the third chamber to the single chamber, or opening the first pneumatic valve and moving 1 to 10 µL of the sample from the second chamber to the single chamber. 72. The method of any one of claims 67-71, wherein the method further comprises incubating the sample in the single chamber for from 1 minute to 10 minutes. 73. The method of claim 67, wherein the single chamber has an opening. 74. The method of any one of claim 67 or 73, wherein the single chamber and a second chamber having an opening are positioned in a fixed layer, wherein the second chamber comprises the sample, and wherein the fixed layer is coupled to a sliding layer comprising a channel having a first opening and a second opening. 75. The method of claim 74, wherein the fixed layer further comprises a third chamber having an opening, wherein the third chamber comprises a dNTP, a forward primer, a reverse primer, and a polymerase. 76. The method of claim 75, wherein the opening in the second chamber is aligned with an opening in a first side channel, the opening in the third chamber is aligned with an opening in a second side channel, and the opening in the single chamber is aligned with an opening in a third side channel. 77. The method of any one of claims 73-76, wherein the method comprises one or more of the following steps: sliding the sliding layer to overlap the opening of the second chamber with the opening of the channel; moving the sample from the second chamber into the channel; aspirating the sample from the channel into the first side channel and mixing; sliding the sliding layer to overlap the opening of the channel with the opening of the third chamber; dispensing the sample into the third chamber; moving the sample from the third chamber into the channel; aspirating the sample from the channel into the second side channel and mixing; sliding the sliding layer to overlap the opening of the channel with the opening of the single chamber; and dispensing the sample into the single chamber. 78. The method of any one of claims 73-76, wherein the method comprises one or more of the following steps: sliding the sliding layer to overlap the opening of the second chamber with the opening of the channel; moving the sample from the second chamber into the channel; aspirating the sample from the channel into the first side channel and mixing; sliding the sliding layer to overlap the opening of the channel with the opening of the single chamber; and dispensing the sample into the single chamber. 79. The method of any one of claims 43-78, wherein the measuring comprises fluorescence imaging, spectrophotometry, or electrochemical measurements. 80. The method of any one of claims 43-79, wherein the programmable nuclease, the reporter, the guide nucleic acid, or any combination thereof are lyophilized or vitrified. 81. The method of any one of claims 43-80, wherein the guide nucleic acid comprises from 2 to 20 guide RNAs and wherein a guide RNA of the from 2 to 20 guide RNAs is a unique guide RNA. 82. The method of any one of claim 43-81, wherein the reporter is immobilized to a surface in the single chamber. 83. The method of claim 82, wherein the surface is a surface of the single chamber or a surface of a bead. 84. The device of any one of claims 1-42 or the method of any one of claims 43-83, wherein the target nucleic acid is from influenza A virus, influenza B virus, RSV, dengue virus, West Nile virus, Hepatitis Virus C, Hepatitis Virus A, Hepatitis Virus B, papillomavirus, HIV, *chlamydia*, gonorrhea, syphilis, trichomoniasis, *borrelia*, zika virus, or a sepsis causing organism. 85. The device or method of any one of claims 1-84, wherein the programmable nuclease is a programmable Type V CRISPR/Cas enzyme. 86. The device or method of claim 85, wherein the programmable Type V CRISPR/Cas enzyme is a programmable Cas12 nuclease. 87. The device or method of claim 86, wherein the programmable Cas12 nuclease is Cas12a, Cas12b, Cas12c, Cas12d, or Cas12e. 88. The device or method of claim 85, wherein programmable Type V CRISPR/Cas enzyme is a programmable Cas14 nuclease. 89. The device or method of claim 88, wherein the programmable Cas14 nuclease is Cas14a, Cas14b, Cas14c, Cas14d, Cas14e, Cas14f, Cas14g, or Cas14h. 90. The device or method of any one of claims 1-89, wherein the programmable nuclease is a programmable Type VI CRISPR/Cas enzyme. 91. The device or method of claim 90, wherein the programmable Type VI CRISPR/Cas enzyme is a programmable Cas13 nuclease. 92. The device or method of claim 91, wherein the programmable Cas13 nuclease is Cas13a, Cas13b, Cas13c, Cas13d, or Cas13e. 93. The use of a programmable nuclease in a device for measuring a signal, wherein the device comprises: i) a first chamber comprising a sample and a buffer for lysing the sample; ii) a second chamber, fluidically connected by a first pneumatic valve to the first chamber, wherein the second chamber comprises the programmable nuclease and a reporter comprising a nucleic acid and a detection moiety, and wherein the second chamber is coupled to a measurement device for measuring the signal from the detection moiety produced by cleavage of the nucleic acid of the reporter. 94. The use of a programmable nuclease in a device for measuring a signal, wherein the device comprises: a sliding layer comprising a channel with an opening at a first end of the channel and an opening at a second end of the channel; and a fixed layer comprising: iii) a first chamber having an opening; iv) a second chamber having an opening, wherein the second chamber comprises the programmable nuclease and a reporter comprising a nucleic acid and a detection moiety; v) a first side channel having an opening aligned with the opening of the first chamber; and vi) a second side channel having an opening aligned with the opening of the second chamber, wherein the sliding layer and the fixed layer move relative to each other to fluidically connect the first chamber and the first side channel via the opening at the first end of the channel, the opening at the second end of the channel, the opening of the first chamber, and the opening of the first side channel, and wherein the sliding layer and the fixed layer move relative to each other to fluidically connect the second chamber and the second side channel via the opening at the first end of the channel, the opening at the second end of the channel, the opening of the second chamber, and the opening of the second side channel. 95. The use of a programmable nuclease in a device for measuring a signal, wherein the device comprises: a chamber comprising i) a programmable nuclease; and ii) an immobilized reporter comprising a nucleic acid, an affinity molecule, and a detection moiety; and a lateral flow strip comprising: i) a first region comprising a capture molecule specific for the affinity molecule; and ii) a second region comprising an antibody, wherein the first region is upstream of the second region and the chamber is upstream of the lateral flow strip and wherein the first molecule binds to the second molecule. 96. The use of a hybrid reporter in a method of detecting a target nucleic acid in a sample, the method comprising: contacting the sample to: i) a guide nucleic acid having at least 10 nucleotides reverse complementary to the target nucleic acid; and ii) a programmable nuclease activated upon binding of the guide nucleic acid to the target nucleic acid; iii) a hybrid reporter comprising a detection moiety and a nucleic acid having at least one ribonucleotide and at least one deoxyribonucleotide; detecting a presence or an absence of the target nucleic acid by measuring a signal produced by cleavage of the nucleic acid of the hybrid reporter, wherein cleavage occurs when the programmable nuclease is activated.

EXAMPLES

The following examples are illustrative and non-limiting to the scope of the devices, systems, fluidic devices, kits, and methods described herein.

Example 1

Testing of One Communicable Disease

A biological sample from an individual is tested to determine whether the individual has a communicable disease. The biological sample is tested to detect the presence or absence of a target nucleic acid indicative of a bacteria or a virus responsible for the communicable disease.

A biological sample of urine of an individual is obtained and the biological sample is applied to the reagents described herein in a reagent chamber provided in a kit. The reagents are comprised of a guide nucleic acid targeting a nucleic acid present in and specific to the bacteria or the virus, a programmable nuclease, and a single stranded detector nucleic acid with a detection moiety. The virus responsible for the communicable disease, and the target nucleic acid from the bacteria or the virus binds to the guide nucleic acid and activates the programmable nuclease to cleave the target nucleic acid and the single stranded detector nucleic acid, is found in the biological sample. In some examples, a CRISPR/Cas nuclease is used as the programmable nuclease.

After the sample and the reagents are contacted for a predetermined time, the reacted sample and reagents are applied to a sample pad region on a support medium. The support medium is comprised of a lateral flow assay test strip encased in a protective housing with openings for the sample pad region to apply the reacted sample and reagents and for a detection region for reading the test results. Fiduciary markers, a reference color scale, and a barcode that identifies the test performed by the kit is found in the housing. As the reacted sample and reagents are moved along the lateral flow assay test strip to the detection region, the detection moiety from the cleaved single stranded detector nucleic acid are bound to a capture molecule on the support medium and a detection molecule in a detection region to generate a detectable signal on the support medium. The detectable signal is shown as a line in the detection region of the support medium. Once the test is completed, a line for a positive control marker and another line for a positive test are visible through the detection region opening.

After a predetermined amount of time after applying the reacted sample and reagents to the support medium, a mobile device to obtain the test results is used by the individual. A mobile application for reading of the test results on a mobile device with a camera is opened by the individual and an image of the support medium is taken, including the detection region, barcode, reference color scale, and fiduciary markers on the housing, using the camera of the mobile device and the GUI of the mobile application. The test based on the barcode in the image is identified by the mobile application, the detection region in the image with the fiduciary markers and a reference color scale on the housing in the same image is analyzed based on the identification of the test with the barcode, and the presence or absence of the bacteria or the virus responsible for a communicable disease is determined. The results of the test are presented to the individual by the mobile application. The test results are stored in the mobile application. A remote device is used to communicate with the mobile application and the data of the test results is transferred to the remote device. The test results are viewed remotely from the remote device by another individual, such as a healthcare professional.

Example 2

Testing of One Communicable Disease—Dipstick Method

A biological sample from an individual is tested to determine whether the individual has a communicable disease. The biological sample is tested to detect the presence or absence of a target nucleic acid indicative of a bacteria or a virus responsible for the communicable disease.

A biological sample of urine is obtained from an individual and the biological sample is applied to the reagents as described herein in a reagent chamber provided in a kit. The reagents are comprised of a guide nucleic acid targeting a nucleic acid present in and specific to the bacteria or the virus, a programmable nuclease, and a single stranded detector nucleic acid. In some examples, a CRISPR/Cas nuclease is used as the programmable nuclease.

After the sample and the reagents are contacted for a predetermined time, one end of a support medium is placed into the reagent chamber by an individual to apply the reacted sample and reagents to a sample pad region on the support medium. The support medium is comprised of a lateral flow assay test strip. As the reacted sample and reagents are moved along the test strip to the detection region, a line for a positive control marker is observed (e.g. is visible) in the detection region. After a predetermined amount of time after applying the reacted sample and reagents to the support medium, the support medium is placed into a protective housing with an opening for the detection region for reading the test results, fiduciary markers, a reference color scale, and a barcode that identifies the test performed by the kit.

A mobile device is used to obtain the test results. A mobile application for reading of the test results on a mobile device with a camera is opened and an image of the support medium is taken, including the detection region, barcode, reference color scale, and fiduciary markers on the housing, using the camera of the mobile device and the mobile application. The test based on the barcode in the image is identified by the mobile application, the detection region in the image with the fiduciary markers and a reference color scale is analyzed on the housing in the same image based on the identification of the test with the barcode, and the presence or absence of the bacteria or the virus responsible for a communicable disease is determined. The results of the test are presented to the individual by the mobile application. The test results are stored in the mobile application. A remote device is used to communicate with the mobile application and the data of the test results is transferred to the remote device. The test results are viewed remotely from the remote device by another individual, such as a healthcare professional.

Example 3

Testing of One Communicable Disease—In Situ Cleaving on Support Medium

A biological sample from an individual is tested to determine whether the individual has a communicable disease. The biological sample is tested to detect the presence or absence of a target nucleic acid indicative of a bacteria or a virus responsible for the communicable disease.

A biological sample of urine is obtained by an individual and the biological sample is applied to the reagents described herein on a sample pad region on a support medium provided in a kit. The reagents are comprised of a guide nucleic acid targeting a nucleic acid present in and specific to the bacteria or the virus, a programmable nuclease, and a single stranded detector nucleic acid. The support medium is comprised of a lateral flow assay test strip encased in a protective housing with an opening for the detection region for reading the test results, fiduciary markers, a reference color scale, and a barcode that identifies the test performed by the kit.

After the sample and the reagents are contacted for a predetermined time on the support medium, the reacted sample and reagents are moved along the support medium to a detection region on the support medium. Optionally, a small volume of buffer is placed is used to help move the reacted sample and reagents to the detection region. As the reacted sample and reagents are moved along the test strip to the detection region, a line for a positive control marker is observed (e.g., is visible) in the detection region.

A mobile device is used to obtain the test results. The test based on the barcode in the image is identified by a mobile application on the mobile device, the detection region in the image is analyzed, and the presence or absence of the bacteria or the virus responsible for a communicable disease is determined. The results of the test are presented to the individual by the mobile application. The test results are stored in the mobile application. A remote device is used to communicate with the mobile application and the data of the test results is transferred to the remote device. The test results are viewed remotely from the remote device by another individual, such as a healthcare professional.

Example 4

Testing of Multiple Communicable Diseases—Multiple Lateral Flow Assay

A biological sample from an individual is tested to determine whether the individual has one or more communicable diseases. The biological sample is tested to detect the presence or absence of one or more of target nucleic acids, where the individual target nucleic acid is indicative of a bacteria or a virus responsible for one of the communicable diseases.

A biological sample of urine is obtained and the biological sample is applied to multiple reagent chambers provided in a kit to test for a panel of communicable diseases. Each reagent chamber is comprised of the reagents specific to detect one communicable disease. The reagents in each reagent chamber is comprised of a guide nucleic acid targeting a nucleic acid present in and specific to the bacteria or the virus; a programmable nuclease; and a single stranded detector nucleic acid.

After the sample and the reagents are contacted for a predetermined time, the reacted sample and reagents is applied from one of the reagent chambers to a matched sample pad region on a support medium. Each reagent chamber is comprised of a matching sample pad region on the support medium. The support medium is comprised of multiple lateral flow assay test strips encased in a protective housing with openings for the matched sample pad regions to apply the reacted sample and reagents from the matching reagent chamber and for a detection region for reading the test results. Fiduciary markers, a reference color scale, and a barcode that identifies the tests performed by the kit are located in the housing. As the reacted sample and reagents are moved along the lateral flow assay test strip to the detection region, a positive control marker for each lateral flow test strip is observed (e.g., is visible) through the detection region opening.

After a predetermined amount of time after applying the reacted sample and reagents to the support medium, a mobile device is used to obtain the test results. A mobile application on the mobile device is used to identify the test based on the barcode in the image, analyze the detection region in the image, and determine the presence or absence of the bacteria or the virus responsible for a communicable disease. The results of the test are presented to the individual by the mobile application. The test results are stored in the mobile application. A remote device is used to communicate with the mobile application and the data of the test results is transferred to the remote device. The test results are viewed remotely from the remote device by another individual, such as a healthcare professional.

Example 5

Testing of Multiple Communicable Diseases—Multiplexed Lateral Flow Assay

A biological sample from an individual is tested to determine whether the individual has one or more communicable diseases. The biological sample is tested to detect the presence or absence of one or more of target nucleic acids, where the individual target nucleic acid is indicative of a bacteria or a virus responsible for one of the communicable diseases.

A biological sample of urine is obtained and the biological sample is applied to a reagent chamber provided in a kit to test for a panel of communicable diseases. The reagent chamber is comprised of multiple sets of reagents to detect multiple communicable diseases. One set of reagents to detect one communicable disease is comprised of a guide nucleic acid targeting a nucleic acid present in and specific to the bacteria or the virus for the communicable disease; a programmable nuclease; and a single stranded detector nucleic acid. Often, the communicable disease is identified as sepsis.

After the sample and the reagents are contacted for a predetermined time, the reacted sample and reagents are applied to a sample pad region on a support medium. The support medium is comprised of a multiplexed lateral flow assay test strip that detects multiple detector molecules on the test strip. The lateral flow assay strip is encased in a protective housing with openings for the sample pad region to apply the reacted sample and reagents and for a detection region for reading the test results. Fiduciary markers, a reference color scale, and a barcode that identifies the tests performed by the kit are also located in the housing. As the reacted sample and reagents are moved along the lateral flow assay test strip to the detection region, a positive control marker for each lateral flow test strip is observed (e.g., is visible) through the detection region opening.

After a predetermined amount of time after applying the reacted sample and reagents to the support medium, a mobile device is used to obtain the test results. A mobile application on the mobile device is used to identify the test based on the barcode in the image, analyze the detection region in the image, and determine the presence or absence of the bacteria or the virus responsible for a communicable disease. The results of the test are presented to the individual by the mobile application. The test results are stored in the mobile application. A remote device is used to communicate with the mobile application and the data of the test results is transferred to the remote device. The test results are viewed remotely from the remote device by another individual, such as a healthcare professional.

Example 6

Testing of RNA reporter molecules in an LbuCas13a assay.

The fluorescence of RNA reporter molecules were tested for use with LbuCas13 assays. The reporter molecules tested were FAM-UU: /56-FAM/TTrUrUTT (SEQ ID NO: 5)/3IABkFQ/; FAM-UU-long: 56-FAM/TTTTrUrUTTTT (SEQ ID NO: 4)/3IABkFQ/; FAM-AU: /56-FAM/TArA-rUGC(SEQ ID NO: 6)/3IABkFQ/; FAM-UG: /56-FAM/TArUrGGC(SEQ ID NO: 7)/3IABkFQ/; FAM-U10: /56-FAM/rUrUrUrUrUrUrUrUrU (SEQ ID NO: 3)/3IABkFQ/; FAM-U5: /56-FAM/rUrUrUrU (SEQ ID NO: 1)/3IABkFQ/; FAM-U8: /56-FAM/rUrUrUrUrU-rUrU (SEQ ID NO: 2)/3IABkFQ/; and RNAse Alert: Proprietary reporter from Integrated DNA Technologies RNaseAlert Substrate Nuclease Detection System. 56-FAM is 5' 6-Fluorescein dye that emits light at about 520 nm and 3IABkFQ is 3' Iowa Black FQ, which is a quencher for use with fluoroscein and other fluorescent dyes that emit in the green to pink spectral range. Each reporter was tested, from left to right, with no enzyme (no LbuCas13a), with RNAse A, with LbuCas13a but without a target nucleic acid; or with LbuCas13a and with the target nucleic acid, as shown in FIG. 1. When tested with no enzyme (negative control), all reporters showed little to no relative fluorescence. When tested with RNAse A (positive control), all reporters exhibited high fluorescence. When tested with LbuCas13a without a target nucleic acid (inactive LbuCas13a), the "best" reporters generated very little fluorescence, such as the FAM-U5 and FAM-UU-long reporters. The RNAse Alert, which is the current standard reporter, showed significant fluorescence. When tested with LbuCas13a with a target nucleic acid (active LbuCas13a), the "best" reporters generated high fluorescence, such as the U5 and UU-long reporters.

Example 7

Mixing CRISPR RNAs (crRNAs) in a Single Reaction Allowed Detection of Two Species' RNA Simultaneously The fluorescent signal of samples with crRNAs from two species for detection of RNA was tested. In this assay, the fluorescent signal of samples with various combinations of no RNA, RNA from *E. coli* only, RNA from *Chlamydia* only, or RNA from both *Chlamydia* and *E. coli* mixed with CRISPR RNAs (crRNAs) for the *Chlamydia* RNA, crRNAs for the *E. coli* RNA, or crRNAs for *Chlamydia* RNA mixed with crRNAs for *E. coli* RNA was assessed as shown in FIG. 2.

The mixed crRNAs of crRNAs for *E. coli* RNA and crRNAs for *Chlamydia* RNA produced fluorescent signal in samples comprising RNA from *E. coli* mixed with RNA from *Chlamydia*; RNA from *E. coli* only; or RNA from *Chlamydia* only. The RNA from *E. coli* mixed with RNA from *Chlamydia* produced fluorescent signal in samples comprising crRNAs for *E. coli* RNA mixed with crRNAs for *Chlamydia* RNA; crRNAs for *E. coli* RNA only; or crRNAs for *Chlamydia* RNA only. crRNAs for *Chlamydia* RNA produced fluorescent signal in the sample comprising RNA from *Chlamydia*. crRNA for *E. coli* RNA produced fluorescent signal in the sample comprising *E. coli* RNA. The individual crRNAs did not produce fluorescent when mixed with the non-matching target RNA or with no RNA. All the assay samples also comprised Cas13a.

Example 8

Mixing Multiple crRNAs Against the Same Gene or Species Increases Fluorescent Signal The fluorescent signal of samples with different crRNAs for detection of RNA was tested. The fluorescent signal for three different crRNAs either individually or as a mixture of all three crRNAs, with either no RNA (dark bars; 0.0 nM RNA) or a target RNA with sites for all three crRNAs (light bars; 0.001 nM RNA) was detected as shown in FIG. 3.

The mixing of all three crRNAs produced more signal than a single crRNA of each of the three different crRNAs. Therefore, mixing different crRNAs may be a strategy to increase fluorescent signal of an assay, and thus increase assay sensitivity.

Example 9

Autofluorescent Signal in Urine at Various Wavelengths

The autofluorescent signal in human urine was tested at different wavelengths associated with different fluorophores as shown in FIG. 4. Human urine has increased autofluorescence in the wavelengths associated with detection of FAM-based reporter molecules, whereas the autofluorescence of urine was not as prevalent in the wavelengths associated with detection of AlexaFluor594, ATTO633, TYE665, or IRDYE700 fluorescent dyes.

Example 10

Use of RNAse Inhibitors for Cas13a Assays in Urine

The fluorescent signal in urine with different RNAse inhibitors was tested. The fluorescent signal in a urine fraction of 0 (buffer only; control) or a urine fraction of 0.18 (18% urine in buffer) with no RNAse inhibitor (left panel), with RibLock RNAse inhibitor (middle panel), or with polyvinyl sulfonic acid (PVS) (right panel) was detected as shown in FIG. 5A. Each of these conditions was tested with Cas13a, RNA reporter molecules, and either 0.0 nM target RNA or 0.09 nM target RNA.

In the urine fraction of 0 tested without RNAse inhibitor (left panel of FIG. 5A), the fluorescent signal was produced only in the presence of target RNA, indicating the Cas13 assay works in buffer. However, in the urine fraction of 0.18 without RNAse inhibitor (left panel of FIG. 5A), the sample without the target RNA had high fluorescent signal. This was most likely due to nonspecific RNAses in body fluids/urine cleaving the RNA reporter molecules despite lack of activation of Cas13a. As expected, in the urine fraction of 0.18 without RNAse inhibitor and with the target RNA had high fluorescent signal. * Indicate data was cut-off. FIG. 5B shows the rescaled y-axis for the left panel of FIG. 5A, which the y-axis Fluorescence (AU) was rescaled from 0 to 3000 at intervals of 500 in FIG. 5A to 0 to 12000 at intervals of 2000 in FIG. 5B.

In the urine fraction of 0 tested with RiboLock RNAse inhibitor (middle panel of FIG. 5A), the fluorescent signal was produced only in the presence of target RNA, indicating Cas13a can cleave RNA reporter molecules in the presence of RiboLock RNAse inhibitor. In the urine fraction of 0.18 tested with RiboLock RNAse inhibitor, the fluorescent signal was produced only in the presence of the target RNA, indicating that the RiboLock RNAse inhibitor inhibited the endogenous RNAses in the urine.

In the urine fraction of 0 tested with polyvinyl sulfonic acid (PVS) (right panel of FIG. 5A), the fluorescent signal was not produced in the presence of target RNA, indicating Cas13a cleaving RNA reporter molecules was inhibited by the PVS. Furthermore, in the urine fraction of 0.18 tested with PVS, the fluorescent signal, although present, was similar between the samples with or without the target RNA, indicating that the PVS partially inhibited the endogenous RNAses in the urine, but also inhibited the Cas13a cleaving of RNA reporter molecules.

Example 11

Fluorophore Fluorescent Signal in Urine

The fluorescent signal of different fluorophores in urine was tested. FAM, AlexaFluor594, ATTO633, TYE665, and IRDYE700 fluorophores in human urine either with or without RNAse inhibitors was tested. A ratio of fluorescence for the fluorescent signal of the each fluorophore either with or without RNAse inhibitors was used to create the ratio of fluorescence for each fluorophore, which was then normalized to ratio of fluorescence for the FAM fluorophore as is shown in FIG. 6.

Example 12

Comparisons of Different Fluorescent Reporter Molecules with Different Buffers

The fluorescent signal of FAM, TYE665, and IRDYE700 reporter molecules was compared in the original Cas13a buffer (20 mM HEPES pH 6.8, 50 mM KCl, 5 mM $MgCl_2$, and 5% glycerol) versus in an enhanced buffer (MBuffer1; comprising 100 mM Imidazole pH 7.5; 250 mM KCl, 25 mM $MgCl_2$, 50 ug/mL BSA, 0.05% Igepal Ca-630, and 25% Glycerol). Furthermore, the reporter performance was evaluated in the standard Cas13a detection assay (original buffer) with 100 fM target RNA (FIG. 7A) or in urine with 10 pM target RNA (FIG. 7B).

As shown in FIG. 7A, the background subtracted fluorescent signal of RNA reporter molecules with Cas13a and 100 fM of target RNA in either the original Cas13a buffer or an enhanced buffer (MBuffer1) was detected.

As shown in FIG. 7B, the background subtracted fluorescent signal of RNA reporter molecules with Cas13a and 10 pM of target RNA in either the original Cas13a buffer or an enhanced buffer (MBuffer1) was detected.

For FIG. 7A and FIG. 7B, FAM-U5 is /56-FAM/rUrUrUrUrU (SEQ ID NO: 1)/3IABkFQ/; TYE665-U5 is /5TYE665/rUrUrUrUrU (SEQ ID NO: 1)/3IAbRQSp/; and IRDYE700-U5 is /5IRD700/rUrUrUrUrU (SEQ ID NO: 1)/3IRQC1N/. In these reporter molecules, rU indicates a uracil ribonucleotide; 56-FAM indicates 5' 6-Fluorescein dye; 3IABkFQ indicates 3' Iowa Black FQ; 5TYE665 indicates 5' TYE 665; 3IAbRQsp indicates 3' Iowa Black RQ; 5IRD700 indicates 5' IRDye 700; and 3IRQC1N indicates IRDye QC-1 quencher.

Example 13

Testing of *Chlamydia* Infection—In Situ Cleaving on Support Medium

A biological sample from an individual is tested to determine whether the individual has a *Chlamydia* infection. The biological sample is tested to detect the presence or absence of a target nucleic acid comprising GAGTATGG-GAGAGTAGGTCG (SEQ ID NO: 168) indicative of the presence of *Chlamydia* infection.

A biological sample of urine is obtained and the biological sample is applied to the reagents described herein on a sample pad region on a support medium provided in a kit. The reagents are comprised of a guide nucleic acid targeting a nucleic acid present in and specific to *Chlamydia*, a programmable nuclease LbuCas13a, and a single stranded detector nucleic acid. The support medium is comprised of a lateral flow assay test strip encased in a protective housing with an opening for the detection region for reading the test results, fiduciary markers, a reference color scale, and a barcode that identifies the test performed by the kit.

After the sample and the reagents are contacted for a period of time ranging from 5 minutes to 120 minutes on the support medium, the reacted sample and reagents are moved along the support medium to a detection region on the support medium. Optionally, a small volume of buffer is used to help move the reacted sample and reagents to the detection region. As the reacted sample and reagents are moved along the test strip to the detection region, a line for a positive control marker is observed (e.g., is visible) in the detection region.

A mobile device is used to obtain the test results. A mobile application of the mobile device is used to identify the test based on the barcode in the image, analyze the detection region in the image, and determine the presence or absence of the target nucleic acid indicative of *Chlamydia* infection. The test results are viewed by the individual. The test results are stored in the mobile application. A remote device is used to communicate with the mobile application and the data of the test results is transferred to the remote device. The test results are viewed remotely from the remote device by another individual, such as a healthcare professional.

Example 14

Testing of Gonorrhea Infection—In Situ Cleaving on Support Medium

A biological sample from an individual is tested to determine whether the individual has a Gonorrhea infection. The biological sample is tested to detect the presence or absence of a target nucleic acid indicative of the presence of Gonorrhea infection.

A biological sample of urine is obtained and the biological sample is applied to the reagents described herein on a sample pad region on a support medium provided in a kit. The reagents are comprised of a guide nucleic acid targeting a nucleic acid present in and specific to Gonorrhea, a programmable nuclease LbuCas13a, and a single stranded detector nucleic acid. The support medium is comprised of a lateral flow assay test strip encased in a protective housing with an opening for the detection region for reading the test results, fiduciary markers, a reference color scale, and a barcode that identifies the test performed by the kit.

After the sample and the reagents are contacted for a period of time ranging from 5 minutes to 120 minutes on the support medium, the reacted sample and reagents are moved along the support medium to a detection region on the support medium. Optionally, a small volume of buffer is used to help move the reacted sample and reagents to the detection region. As the reacted sample and reagents are moved along the test strip to the detection region, a line for a positive control marker is observed (e.g., is visible) in the detection region.

A mobile device is used to obtain the test results. A mobile application of the mobile device is used to identify the test based on the barcode in the image, analyze the detection region in the image, and determine the presence or absence of the target nucleic acid indicative of Gonorrhea infection. The test results are viewed by the individual. The test results are stored in the mobile application. A remote device is used to communicate with the mobile application and the data of the test results is transferred to the remote device. The test results are viewed remotely from the remote device by another individual, such as a healthcare professional.

Example 15

Testing of *Chlamydia* Infection and Gonorrhea Infection—Multiple Lateral Flow Assay A biological sample from an individual is tested to determine whether the individual has *Chlamydia* and Gonorrhea. The biological sample is tested to detect the presence or absence of one or more of target nucleic acids, where the individual target nucleic acid is indicative of a *Chlamydia* infection or a Gonorrhea infection.

A biological sample of urine is obtained and the biological sample is applied to two reagent chambers provided in a kit to test for *Chlamydia* and Gonorrhea. Each reagent chamber is comprised of the reagents specific to detect either *Chlamydia* or Gonorrhea. The reagents in each reagent chamber is comprised of a guide nucleic acid targeting a nucleic acid present in and specific to either *Chlamydia* or Gonorrhea; a programmable nuclease; and a single stranded detector nucleic acid.

After the sample and the reagents are contacted for a period of time ranging from 5 minutes to 120 minutes, the reacted sample and reagents from one of the reagent chambers is applied to a matched sample pad region on a support medium. Each reagent chamber has a matching sample pad region on the support medium. The support medium is comprised of multiple lateral flow assay test strips encased in a protective housing with openings for the matched sample pad regions to apply the reacted sample and reagents from the matching reagent chamber and for a detection region for reading the test results. Fiduciary markers, a reference color scale, and a barcode that identifies the tests performed by the kit are located in the housing. As the reacted sample and reagents are moved along the lateral flow assay test strip to the detection region, a positive control marker for each lateral flow test strip is observed (e.g., is visible) through the detection region opening.

After a period of time ranging from 1 minute to 120 minutes after applying the reacted sample and reagents to the support medium, a mobile device is used to obtain the test results. A mobile application of the mobile device is used to identify the test based on the barcode in the image, analyze the detection region in the image, and determine the presence or absence of the target nucleic acid indicative of *Chlamydia* infection or Gonorrhea infection. The test results are viewed by the individual. The test results are stored in the mobile application. A remote device is used to communicate with the mobile application and the data of the test results is transferred to the remote device. The test results are viewed remotely from the remote device by another individual, such as a healthcare professional.

Example 16

Testing of *Chlamydia* Infection and Gonorrhea Infection—Multiplexed Lateral Flow Assay A biological sample from an individual is tested to determine whether the individual has *Chlamydia* or Gonorrhea. The biological sample is tested to detect the presence or absence of one or more of target nucleic acids, where the individual target nucleic acid is indicative of a *Chlamydia* infection or Gonorrhea infection.

A biological sample of urine is obtained and the biological sample is applied to a reagent chamber provided in a kit to test for *Chlamydia* infection and Gonorrhea infection. The reagents chamber is comprises od reagents sets to detect either *Chlamydia* or Gonorrhea. One set of reagents to detect *Chlamydia* is comprised of a guide nucleic acid targeting a nucleic acid present in and specific to a *Chlamydia* infection; a first programmable nuclease, LbuCas13a; and at least one population of a first single stranded detector nucleic acid. A second set of reagents to detect Gonorrhea is comprised of a guide nucleic acid targeting a nucleic acid present in and specific to a Gonorrhea infection; a second programmable nuclease, LbaCas13a; and at least one population of a second single stranded detector nucleic acid.

After the sample and the reagents are contacted for a period of time ranging from 5 minutes to 120 minutes, the reacted sample and reagents are applied to a sample pad region on a support medium. The support medium is comprised of a multiplexed lateral flow assay test strip that can detect the at least one population of first single stranded detector nucleic acid and the at least one population of second single stranded detector nucleic acid on the test strip. The lateral flow assay strip is encased in a protective housing with openings for the sample pad region to apply the reacted sample and reagents and for a detection region for reading the test results. Fiduciary markers, a reference color scale, and a barcode that identifies the tests performed by the kit are located in the housing. As the reacted sample and reagents are moved along the lateral flow assay test strip to the detection region, a positive control marker for each lateral flow test strip is observed (e.g., is visible) through the detection region opening.

After a period of time ranging from 1 minute to 120 minutes after applying the reacted sample and reagents to the support medium a mobile device is used to obtain the test results. A mobile application of the mobile device is used to identify the test based on the barcode in the image, analyze the detection region in the image, and determine the presence or absence of a *Chlamydia* infection and a Gonorrhea infection. The test results are viewed by the individual. The test results are stored in the mobile application. A remote device is used to communicate with the mobile application and the data of the test results is transferred to the remote device. The test results are viewed remotely from the remote device by another individual, such as a healthcare professional.

Example 17

Testing of Cancer Gene—In Situ Cleaving on Support Medium

A biological sample from an individual is tested to determine whether the individual has a cancer associated with the expression of a specific gene, such as EGFR, T2ERG, PCA3, or PSA. The biological sample is tested to detect the presence or absence of a target nucleic acid indicative of the presence of the expression of the cancer gene. Blood, plasma, cfDNA, liquid biopsy, or urine is used as the biological sample. For example, for EGFR detection, a blood sample is obtained for testing. For T2ERG, PCA3, or PSA, a urine sample is obtained for testing.

A biological sample is obtained and the biological sample is applied to the reagents described herein on a sample pad region on a support medium provided in a kit. The reagents are comprised of a guide nucleic acid targeting a cancer gene such as EGFR, T2ERG, PCA3, or PSA, a programmable nuclease such as a Cas12 or Cas14 protein, and a single stranded detector nucleic acid. The support medium is comprised of a lateral flow assay test strip encased in a protective housing with an opening for the detection region for reading the test results, fiduciary markers, a reference color scale, and a barcode that identifies the test performed by the kit.

After the sample and the reagents are contacted for a period of time ranging from 5 minutes to 120 minutes on the support medium, the reacted sample and reagents are moved along the support medium to a detection region on the support medium. Optionally, a small volume of buffer is used to help move the reacted sample and reagents to the detection region. As the reacted sample and reagents are moved along the test strip to the detection region, a line for a positive control marker is observed (e.g., is visible) in the detection region.

A mobile device is used to obtain the test results. A mobile application of the mobile device is used to identify the test based on the barcode in the image, analyze the detection region in the image, and determine the presence or absence of the target nucleic acid indicative of expression of the cancer gene. The test results are viewed by the individual. The test results are stored in the mobile application. A remote device is used to communicate with the mobile application and the data of the test results is transferred to the remote device. The test results are viewed remotely from the remote device by another individual, such as a healthcare professional.

Example 18

Testing of Genetic Disorder—In Situ Cleaving on Support Medium

A biological sample from an individual is tested to determine whether the individual has a genetic disorder, such as cystic fibrosis or celiac disease, based on the expression of a specific gene. The biological sample is saliva and is tested to detect the presence or absence of a target nucleic acid indicative of the presence of the expression of the gene associated with the genetic disorder.

A biological sample of saliva is obtained and the biological sample is applied to the reagents described herein on a sample pad region on a support medium provided in a kit. The reagents are comprised of a guide nucleic acid targeting a gene associated with a genetic disorder, a programmable nuclease such as LbaCas12a protein or a Cas14 protein, and a single stranded detector nucleic acid. The support medium is comprised of a lateral flow assay test strip encased in a protective housing with an opening for the detection region for reading the test results, fiduciary markers, a reference color scale, and a barcode that identifies the test performed by the kit.

After the sample and the reagents are contacted for a period of time ranging from 5 minutes to 120 minutes on the support medium, the reacted sample and reagents are moved along the support medium to a detection region on the support medium. Optionally, a small volume of buffer is used to help move the reacted sample and reagents to the detection region. As the reacted sample and reagents are moved along the test strip to the detection region, a line for a positive control marker is observed (e.g., is visible) in the detection region.

A mobile device is used to obtain the test results. A mobile application of the mobile device is used to identify the test based on the barcode in the image, analyze the detection region in the image, and determine the presence or absence of the target nucleic acid indicative of expression of the gene associated with the genetic disorder. The test results are viewed by the individual. The test results are stored in the mobile application. A remote device is used to communicate with the mobile application and the data of the test results is transferred to the remote device. The test results are viewed remotely from the remote device by another individual, such as a healthcare professional.

Example 19

Detection of a Single Nucleotide Polymorphism (SNP) Versus Wild-Type (WT) in *P. falciparum*

This example shows that Cas12a can be used to detect a single nucleotide polymorphism (SNP) versus wild-type (WT) allele in *P. falciparum*. Ketch 13 mutants in *P. falciparum* are associated with Artemisinin resistance.

Cas is used for detection of a WT allele of kelch13 versus detection of a C580Y allele of kelch13. FIG. 8A is a schematic showing a guide nucleic acid (gRNA) for detection of a WT allele of kelch13, and a gRNA for detection of a C580Y allele of kelch13. The gRNA for detection of a WT allele of kelch13 binds to the WT allele of kelch13, but does not bind to the kelch13 C580Y allele. The gRNA for detection of the kelch13 C580Y allele binds to the kelch13 C580Y allele, but does not bind to the kelch13 WT allele.

FIG. 8B shows Cas12a detected WT kelch13 versus a kelch13 SNP responsible for Artemisinin resistance in *P. falciparum*. For the WT kelch13, the WT kelch13 gRNA (WT gRNA) produced fluorescence in the presence of the WT kelch13 target nucleic acid molecule (WT target) but not in the presence of the target kelch13 nucleic acid molecule comprising the SNP (mut target). For the kelch13 SNP, the kelch13 SNP gRNA (mut gRNA) produced fluorescence in the presence of the target kelch13 nucleic acid molecule comprising the SNP (mut target), but not in the presence of the WT target. Therefore, Cas12a detected a SNP versus WT allele.

Example 20

Detection of a Single Nucleotide Polymorphism (SNP) Versus Wild-Type (WT) in N. Gonorrhea This example shows that Cas12a can be used to detect a single nucleotide polymorphism (SNP) versus wild-type (WT) allele in N. gonorrhea. A SNP mutant allele in N. gonorrhea is associated with azithromycin resistance.

FIG. 8C shows species-specific detection of 16 S of N. gonorrhea by Cas13 using a reporter molecule (/5-6FAM/ rUrUrUrUrU (SEQ ID NO: 1)/3IABkFQ/) and detection of an azithromycin resistance SNP for N. gonorrhea (23 S mutant) versus wild-type (23 S WT) N gonorrhea by Cas12 using a reporter molecule (/AF594/TTATTATT/ 3IAbRQSp/), all in a single reaction. The top grid shows detection of N. gonorrhea using a Cas13 species-specific 16 S gRNA and detection of WT 23 S using a Cas12 gRNA targeting the 23 S WT, indicating the N. gonorrhea is susceptible to antibiotic treatment using azithromycin. The bottom grid shows detection of N. gonorrhea using a Cas13 species-specific 16 S gRNA and detection of mutant 23 S using a Cas12 gRNA targeting the 23 S mutant, indicating the N. gonorrhea is resistant to antibiotic treatment using azithromycin.

Example 21

Detection of a Nucleic Acid Using a Fluidic Device

This example illustrates detection of a nucleic acid using programmable nuclease in a fluidic device. In some examples, a CRISPR/Cas nuclease is used as the programmable nuclease, and a CRISPR-Cas reaction for detection of a target nucleic acid in a sample is carried out using a fluidic device.

FIG. 9 shows a schematic illustrating a workflow of the CRISPR-Cas reaction. Step 1 in the workflow is sample preparation, Step 2 in the workflow is nucleic acid amplification. Step 3 in the workflow is Cas reaction incubation. Step 4 in the workflow is detection (readout). Steps 1 and 2 are optional, and steps 3 and 4 can occur concurrently, if detection and readout are incorporated to the Cas reaction. FIG. 10 shows a fluidic device for sample preparation that is used. The sample preparation fluidic device processes different types of biological sample. The biological sample is finger-prick blood, urine or swabs with fecal, cheek or other collection. The sample is prepared in a fluidic device of FIG. 10 and is then introduced into a fluidic device.

The fluidic device is one of the three fluidic devices of FIG. 11 or the fluidic device of FIG. 13. The three fluidic devices of FIG. 11 carry out a Cas reaction with a fluorescence or electrochemical readout. An exploded view diagram summarizing the fluorescence and electrochemical processes that are used for detection of the reaction are shown in FIG. 12. FIG. 12 shows schematic diagrams of a readout process that are used including (a) fluorescence readout and (b) electrochemical readout. FIG. 13 shows a fluidic device for coupled invertase/Cas reactions with colorimetric or electrochemical/glucometer readout. This diagram illustrates a fluidic device for miniaturizing a Cas reaction coupled with the enzyme invertase. Surface modification and readout processes are depicted in exploded view schemes at the bottom including (a) optical readout using DNS, or other compound and (b) electrochemical readout (electrochemical analyzer or glucometer).

A sample containing a target nucleic acid of interest is introduced into a fluidic device of FIG. 10. The sample is filtered and introduced into a fluidic device of FIG. 11 or FIG. 13, wherein the nucleic acid of interest is, optionally, amplified, and incubated with pre-complexed Cas mix. The Cas-gRNA complex binds to its matching nucleic acid target from the amplified sample and is activated into a non-specific nuclease, which cleaves a nucleic acid-based reporter molecule to generate a signal readout. A target nucleic acid of interest is detected using a fluorescence readout, an electrochemical readout, or an electrochemiluminescence readout, as shown in FIG. 12 or an optical readout or electrochemical readout, as shown in FIG. 13.

Example 22

Detection of Circulating RNA

This example illustrates a workflow for detection of circulating RNA in urine.

FIG. 14A shows diagram for the detection workflow of a target nucleic acid in sample of patient urine. First, RNA is extracted from the urine sample. Then the extracted urine undergoes a pre-amplification step in which the target nucleic acid is amplified. The amplicons are then contacted to Cas13a complexed with a guide nucleic that binds to the amplicons, which initiates cleavage of a detector nucleic acid comprising a fluorophore attached to a quencher by a nucleic acid. Upon cleavage of the detector nucleic acid, the fluorophore is detected as a positive signal, indicating the presence of the target nucleic acid in the sample of patient urine.

Example 23

Detection of Prostate Cancer Biomarkers

This example shows prostate cancer biomarkers are detected using Cas13a. Additionally, this example illustrates that fluorescence output from the cleavage of detector nucleic acids by Cas13a is a linear function of the concentration of the prostate cancer RNA biomarker for each of the three RNA biomarkers tested.

FIG. 14B shows detection of prostate cancer RNA biomarkers using the workflow of FIG. 14A, except the sample is from a prostate cell cancer line. The y-axis is background fluorescence (AU) and the x-axis indicates the detection of different prostate cancer RNA biomarkers (e.g., RNA #1, RNA #2, and RNA #3). Each RNA was detected in the prostate cancer cell line as indicated by the fluorescence. The same workflow and reagents were applied to a water sample and a sample comprising RNA from a cervical cancer cell line, which were negative controls and showed little to no fluorescence indicating target nucleic acids encoding the prostate cancer RNA biomarkers were not present in the samples as expected.

FIG. 14C shows that the fluorescence output as detected for each prostate cancer RNA biomarker in FIG. 14B is a linear function of the concentration of the target nucleic acid comprising encoding the prostate cancer RNA biomarker.

Example 24

HERC2 SNP Detection Using Cas12a

This example illustrates using Cas12a for detection of HERC2 SNPs.

Figure 15:
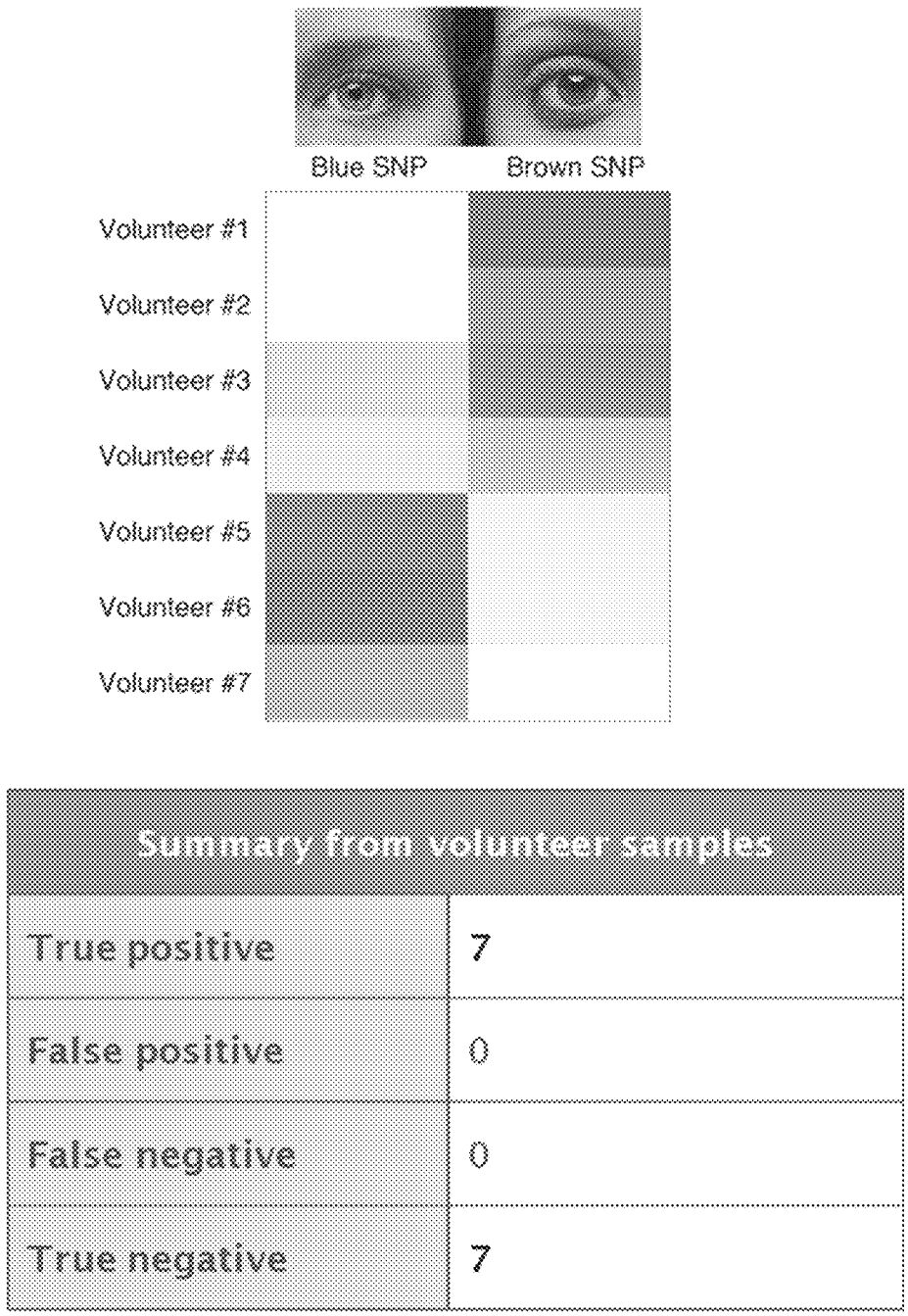
FIG. 15 shows SNP detection using Cas12a with a blue-eye guide nucleic acid or a brown-eye guide nucleic acid in saliva samples from blue-eyed and brown-eyed individuals, which were spatially multiplexed. Amplification of the HERC2 gene from human genomic DNA was conducted by PCR for 20 minutes followed by incubation for 30 minutes with the guide RNA complexed with Cas12a in a 20 µl assay volume. Fluorescence was detected using a plate reader for each sample. Seven volunteer subjects were tested. The brown eye allele of the HERC2 gene was detected in four of the volunteers. The blue eye allele of HERC2 gene was detected in five of the volunteers. Volunteers with both brown and blue eye alleles detected were heterozygotes of the HERC2 gene, but displayed the dominant brown eye color. Of the fourteen tests conducted on the seven volunteer samples, seven were found to true positive, seven were found to be true negative, zero were found to be false positive, and zero were found to be false negative.

FIG. 15 shows SNP detection using Cas12a with a blue-eye guide nucleic acid or a brown-eye guide nucleic acid in saliva samples from blue-eyed and brown-eyed individuals, which were spatially multiplexed. Amplification of the HERC2 gene from human genomic DNA was conducted by PCR for 20 minutes followed by incubation for 30 minutes with the guide RNA complexed with Cas12a in a 20 µl assay volume. Fluorescence was detected using a plate reader for each sample. Seven volunteer subjects were tested. The brown eye allele of the HERC2 gene was detected in four of the volunteers. The blue eye allele of HERC2 gene was detected in five of the volunteers. Volunteers with both brown and blue eye alleles detected were heterozygotes of the HERC2 gene, but displayed the dominant brown eye color. Of the fourteen tests conducted on the seven volunteer samples, seven were found to true positive, seven were found to be true negative, zero were found to be false positive, and zero were found to be false negative.

Example 25

ALDH2 SNP Detection Using Cas12a

This example illustrates using Cas12a for detection of ALDH2 SNPs.

FIG. 16A illustrates that the workflow for the alcohol flush (ALDH2) SNP detection. A saliva sample is taken from a subject and processed to determine the genotype of the subject.

FIG. 16B shows alcohol flush (ALDH2) SNP detection using Cas12a with a guide nucleic acid for the G-SNP or a guide nucleic acid for the A-SNP in saliva samples from three volunteer subjects, which were spatially multiplexed. Amplification of the ALDH2 gene from human genomic DNA was conducted by PCR followed by incubation with each guide RNA complexed with Cas12a in 20 µl assay volumes. Fluorescence was detected using a plate reader for each sample. Both the G-SNP and A-SNP were detected in the sample from volunteer #1. Only the G-SNP was detected in the samples from volunteer #2 and volunteer #3.

FIG. 16C illustrates the genotype/phenotype correlation for the ALDH2 SNP genotypes.

FIG. 16D shows the genotypes of each volunteer by sequencing, which confirms the genotype detected in FIG. 16B using Cas12a.

FIG. 16E is a table summarizing the parameters of FIG. 16B. TAT: turn around time.

Example 26

Syndromic Panel Identification of Sepsis Using Cas12a

This example shows a potential panel of bacterial pathogens that can be used for identification of sepsis.

Figure 17A:
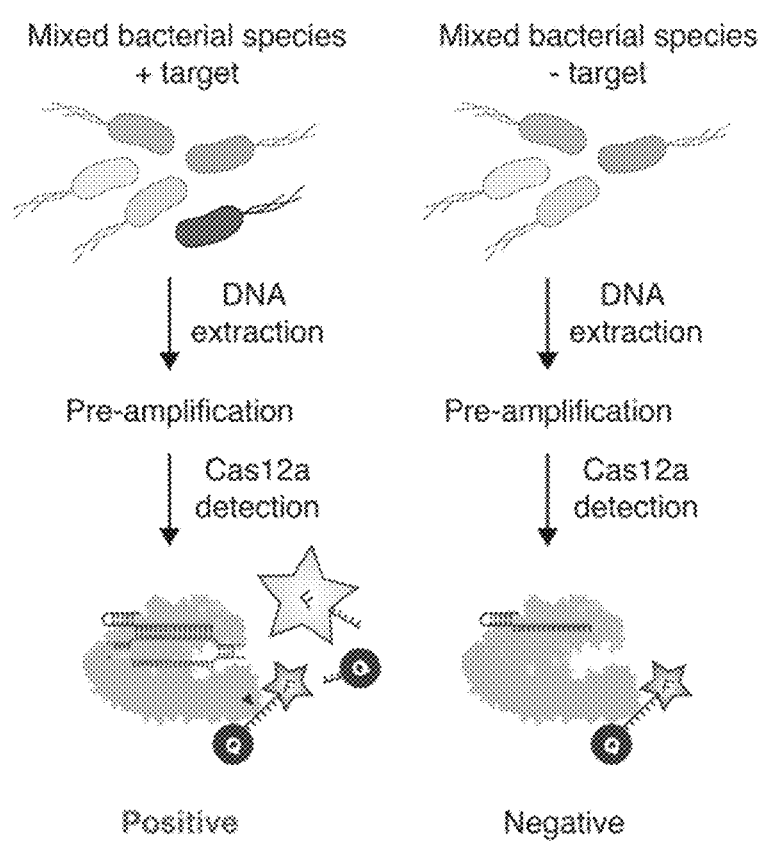
FIG. 17A illustrates the workflow for the exemplary syndromic panel identification of sepsis of FIG. 17B. The workflow on the left shows an input of mixed bacterial species that comprise the target nucleic acids for detection. DNA is extracted from these bacterial species, the target DNA is amplified, and Cas12a complexed to guide RNAs for the target nucleic acids for detection using spatial multiplexing. The binding of the target nucleic acids to the Cas12a complexed to guide RNAs for the target nucleic acids initiates cleavage of a detector nucleic acid comprising a fluorophore attached to a quencher by a nucleic acid. Upon cleavage of the detector nucleic acid, the fluorophore is detected as a positive signal indicating the presence of the bacterial species comprising the target nucleic acids. The workflow on the right shows an input of mixed bacterial species that lack the bacterial species for detection. DNA is extracted from these bacterial species, the DNA is amplified and contacted to Cas12a complexed to guide RNAs for the target nucleic acids for detection using spatial multiplexing. The lack of binding of target nucleic acids due to the absence of the target nucleic acids to the Cas12a complexed to guide RNAs for the target nucleic acids due to the absence of the target nucleic acids fails to initiate cleavage of a detector nucleic acid comprising a fluorophore attached to a quencher by a nucleic acid. Due to the lack of cleavage of the detector nucleic acid, the fluorophore remains quenched in the intact detector nucleic acid resulting in a negative signal indicating the absence of bacterial species comprising the target nucleic acids.
Figure 17B:
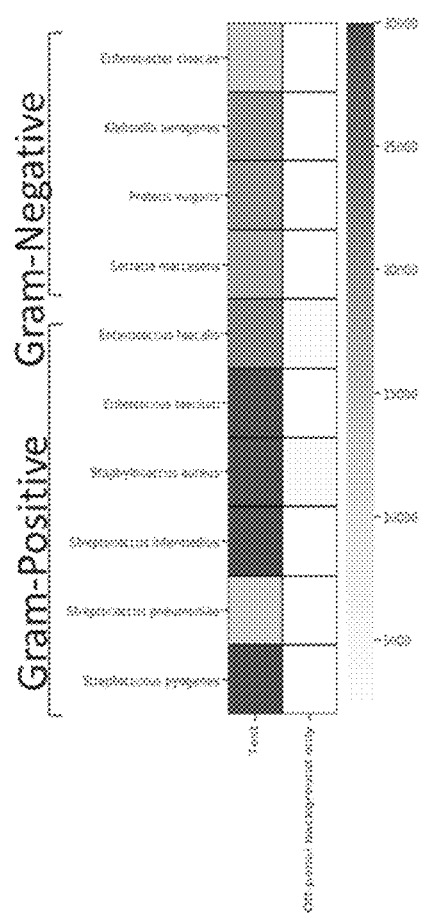
FIG. 17B illustrates an exemplary test panel comprising 6 gram positive and 4 gram negative bacterial pathogens from samples of purified genomic DNA benchmarked to pre-blood culture concentrations that underwent the workflow as shown on the right side of FIG. 17A. The extracted DNA was amplified by PCR and incubated with guide RNA complexed with Cas12a in 20 µl assay volumes, in which the guide RNA bind to the target nucleic acid from the bacterial pathogens. Fluorescence was detected using a plate reader for each sample. The right panel shows that fluorescence was detected for each bacterial pathogen. The turnaround time was 2.5 hours.

FIG. 17A shows the workflow for the exemplary syndromic panel identification of sepsis of FIG. 17B. The workflow on the left shows an input of mixed bacterial species that comprise the target nucleic acids for detection. DNA is extracted from these bacterial species, the target DNA is amplified, and Cas12a complexed to guide RNAs for the target nucleic acids for detection using spatial multiplexing. The binding of the target nucleic acids to the Cas12a complexed to guide RNAs for the target nucleic acids initiates cleavage of a detector nucleic acid comprising a fluorophore attached to a quencher by a nucleic acid. Upon cleavage of the detector nucleic acid, the fluorophore is detected as a positive signal indicating the presence of the bacterial species comprising the target nucleic acids. The workflow on the right shows an input of mixed bacterial species that lack the bacterial species for detection. DNA is extracted from these bacterial species, the DNA is amplified and contacted to Cas12a complexed to guide RNAs for the target nucleic acids for detection using spatial multiplexing. The lack of binding of target nucleic acids due to the absence of the target nucleic acids to the Cas12a complexed to guide RNAs for the target nucleic acids due to the absence of the target nucleic acids fails to initiate cleavage of a detector nucleic acid comprising a fluorophore attached to a quencher by a nucleic acid. Due to the lack of cleavage of the detector nucleic acid, the fluorophore remains quenched in the intact detector nucleic acid resulting in a negative signal indicating the absence of bacterial species comprising the target nucleic acids.

FIG. 17B illustrates an exemplary test panel comprising 4 gram negative (top: *Enterobacter cloacae, Klebsiella aerogenes, Proteus vulgaris*, and *Serratia marcesens*) and 6 gram positive (after gram negative, top: *Enterococcus faecalis, Enterococcus faecium, Staphylococcus aureus, Streptococcus intermedius, Streptococcus pneumoniae*, and *Streptococcus pyogenes*) and bacterial pathogens from samples of purified genomic DNA benchmarked to pre-blood culture concentrations that underwent the workflow as shown on the right side of FIG. 17A. The extracted DNA was amplified by PCR and incubated with guide RNA complexed with Cas12a in 20 µl assay volumes, in which the guide RNA bind to the target nucleic acid from the bacterial pathogens. Fluorescence was detected using a plate reader for each sample. The right panel shows that fluorescence was detected for each bacterial pathogen. The time to readout was 2.5 hours.

Example 27

Cas13a and Cas12a Multiplexing in a One-Pot Reaction for Species Detection and Antibiotic Resistant Allele Detection This example shows that a one-pot reaction with Cas13a and Cas12a successfully detects gonorrhea (species detected by Cas13a), and an antibiotic resistant allele (detected by Cas12a).

FIG. 18A shows Cas13 and Cas12 multiplexing for detection of a bacteria. Cas13 is used for species detection of the bacteria. Cas12 is used to detect a mutation in a locus of the bacteria that confers antibiotic resistance.

FIG. 18B shows a one-pot Cas13a and Cas12a detection coupled with isothermal amplification for detection of gonorrhea. Nucleic acids from a gonorrhea sample were incubated with Cas13a complexed to guide RNAs for the species (gonorrhea) target nucleic acid for detection of the bacteria species and were incubated with Cas12a complexed to guide RNAs for the antibiotic resistance allele target nucleic acid for detection of the antibiotic resistance allele, using multiplexing. The binding of the gonorrhea target nucleic acids to the Cas13a complexed to guide RNAs for the species target nucleic acids initiated cleavage of a detector nucleic acid comprising a fluorophore attached to a quencher by a nucleic acid. Upon cleavage of the detector nucleic acid, the fluorophore was detected as shown in the graph, indicating gonorrhea was present in the sample. Similarly, the binding of the antibiotic resistance allele target nucleic acids to the Cas12a complexed to guide RNAs for the antibiotic resistance allele target nucleic acids initiated cleavage of a detector nucleic acid comprising a fluorophore attached to a quencher by a nucleic acid. Upon cleavage of the detector nucleic acid, the fluorophore was detected as shown in the graph, indicating the antibiotic resistance allele was present in the sample. Samples with *chlamydia* and water were also tested using the same protocol, and as expected, no fluorescence was detected for either sample.

Example 28

Detection of *Chlamydia* Using a Programmable Nuclease

This example shows that *Chlamydia* is detected in a sample by amplification paired with a programmable nuclease with similar sensitivity as qPCR. In some examples, a CRISPR/Cas nuclease is used as the programmable nuclease.

FIG. 19A shows a comparison of detection for *Chlamydia* in 33 patient samples using either qPCR or amplification paired with a CRISPR/Cas nuclease to detect a *Chlamydia* target nucleic acid. Darker shading indicates a stronger signal produced in response to the detection of *Chlamydia* target nucleic acids, while lighter shading indicates a weaker signal. Presence of *Chlamydia* target nucleic acid was measured using qPCR (left) or detection with a programmable nuclease following amplification (amp+CRISPR).

Example 29

Electrochemical Detection of Target Nucleic Acids Using a Programmable Nuclease

This example describes electrochemical detection of target nucleic acids using a programmable nuclease system. Here, a programmable nuclease system was comprised of a DETECTR reaction using a CRISPR/Cas nuclease. In this assay a biotin-streptavidin signal enhancement method was employed using a biotinylated CRISPR-Cas reporter molecule, which is cleaved by the enzyme in the presence of a positive DETECTR reaction (one in which the target nucleic acid is present).

Other methods of electrochemical signal detection which may be used as an alternative to biotin-streptavidin electrochemical detection include (1) use of ferrocene-labelled oligos immobilized on the electrode surface and (2) coupling of DETECTR to an invertase catalyzed reaction, also disclosed herein. The latter reaction will produce glucose that may be detected with a glucometer directly, or indirectly. Electrochemical detection and detection using ferrocene-labelled oligos or using biotin-streptavidin are both potentiometric, while invertase catalyzed reactions are amperometric.

Described here are preliminary results, using a biotinylated reporter for Cas12. The reporter was cleaved using a DNAse enzyme and cleavage resulted in a 21-pA increase in current at an −0.25V oxidation peak compared to when the reporter was intact, demonstrating the use of an electroactive CRISPR reporter in a DETECTR assay.

Results were collected using a benchtop, gold-standard electrochemical analyzer (uSTAT, Metrohm, USA). The sequence of the reporter was /5Biosg/ TTTTTTTTTTTTTTTTTTTT/3MeB1N/ (SEQ ID NO: 169). Signal was detected using a strip-based readout with an electroactive reporter.

The major advancements of this strip compared to existing commercially available strips was the introduction of this new type of CRISPR-Cas electroactive reporter molecule, which was tested in a proof-of-concept assay by cleavage of the DNA reporter with a DNase. The new reporter comprised: (1) a 5'-Biotin moiety and (2) a 3'-methylene blue moiety. FIG. 20A shows a cyclic voltammogram showing potential (V) on the x-axis versus current (µA) on the y-axis for the reporter only versus a cleaved reporter. As shown in the graph, cleavage of the electroactive reporter led to increase in current. The experiment was run in the following conditions: 100 µA sensitivity, 2 mV step, 50 mV amplitude, and 15 Hz frequency. FIG. 20B shows a square wave voltammogram showing potential (V) on the x-axis versus current (µA) on the y-axis for the reporter only versus a cleaved reporter. As shown in the graph, cleavage of the electroactive reporter led to an increase in current. The experiment was run in the following conditions: 100 µA sensitivity, 50 mV step, 50 mV amplitude, 15 Hz frequency.

Example 30

Fluorescence-Based Device for Detection of Target Nucleic Acids Using a Programmable Nuclease System This example describes a fluorescence-based device for detection of target nucleic acids using a programmable nuclease system. Here, a programmable nuclease system was comprised of a DETECTR reaction using a CRISPR/Cas nuclease. Two approaches were used to develop a miniaturized device for DETECTR reactions. First, a glass capillary (Drummond Scientific, USA) was used as a single, capillarity driven vessel of the DETECTR reaction. Both flash-dried and liquid formulations of the reagents were used. Second, a commercially-available, plastic (TOPAS) microfluidic chip (Microfluidic Chip Shop, Germany) with no mechanical actuation for mixing or reagent delivery was used.

Results were collected using (1) a portable, photodiode-based fluorescence sensor (ESELog, Quiagen Lake Constance, Germany) and (2) a commercially-available transilluminator (E-GEL, Thermofisher, USA). The major advancement of the detection capabilities of this system includes the first demonstration of an on-chip DETECTR reaction.

FIG. 21A shows a graph of time in min on the x-axis versus fluorescence (AU) on the y-axis. The graph shows the real-time measurement of fluorescence from a one-pot reverse transcription-recombinase polymerase amplification-in vitro transcription (RT-RPA-IVT)-DETECTR reaction carried out on chip. FIG. 21B shows images of the entire microfluidic chip used for the DETECTR reactions depicted in FIG. 21A under an E-GEL transilluminator. Shown at left is time 0 and shown at right is at time of 35 min. The green bands at t=35 min are the two positive control ("PC") reaction chambers. The negative control ("NC") reaction chambers do not show fluorescent bands. FIG. 21C shows a photograph of the prototype set-up (left image in figure) of the fluorescence-based readout for the on-chip, one-pot DETECTR reaction of this example. This photograph shows an example of a breadboard prototype (top right image in figure). The equipment used are off-the-shelf items including a plastic chip containing the DETECTR reagents from ChipShop made of Zeonor, an ESELog module that is an imager, and a heating component using ChipGenieP from ChipShop. The figure also shows a fluorescence image of eppendorph tubes containing the reaction at 30 minutes (bottom right image in figure).

Test reactions were performed by combining 40 nM crRNA and 40 nM Lbu-WT Cas13a programmable nuclease in MBuffer1. The mixture was incubated at 37° C. for 30 min. A reporter mixture comprising 170 nM reporter (e.g., FAM-U5) and a murine RNase inhibitor (NEB). The crRNA-Cas13a-reporter mixture was then (1) combined with 250 pM target nucleic acid and added to the test chamber (positive control), or (2) added to the test chamber directly (negative control). Alternative methods were tested using 62.5 nM crRNA and 250 nM Lba-WT Cas12a or 62.5 nM crRNA and 50 nM Lba-WT Cas12a.

Example 31

Guide Pooling for High Sensitivity and Broad Spectrum Detection of Target Nucleic Acids This example describes guide pooling for high sensitivity and broad spectrum detection of target nucleic acids. While traditional detection requires one guide RNA per target sequence/organism, the guide pooling methods disclosed herein, including use of multiple gRNAs with one or more CRISPR effector proteins, was found to be amenable for both improving sensitivity (in the case of guide tiling across a single target sequence/organism) and broad spectrum detection (in the case of detecting multiple target sequences/organisms in a single reaction). Thus, guide pooling was a useful method for enhancing detection sensitivity performance as well as functioning as an initial triage step that is rapid and low-cost (e.g., an "alert" for blood-borne pathogens, pandemic flu, pan-bacterial detection, etc.) as compared to traditional diagnostic methods.

To perform DETECTR assay, a guide RNA (crRNA) was first complexed to the Cas protein. The complexing reaction was carried out at 37° C. for 30 minutes. Reporter and additional buffer were then added to complete the complex master mix. Finally, the complex was added to the samples to detect sequences specifically targeted by the guide. By pooling multiple guide RNAs designed to target difference sequences or different sequence segments of the same target, it was possible to broaden the detection spectrum in a single reaction and increase the detection efficiency. To achieve this, guide RNAs were individually complexed to Cas protein at high concentration. Multiple guide-protein complex reactions were pooled. After pooling, the reporter and addition buffer were added to complete the pooled complexes for use in the DETECTR assay.

A. Guide Pooling for Detection of *Borrelia* Strains.

Methods for guide pooling for detection of *Borrelia* strains involved using guide RNAs for 16 S rRNA genes of different *Borrelia* strains. 19 guide RNAs were designed to target 16 S rRNA genes of the *Borrelia* species, *B. burgdorferi*, and/or *B. miyamotoi*. One guide RNA targets the RNase P RNA component H1 gene. TABLE 5 below lists the guide RNAs used in this study.

TABLE 5

| Guide RNA | crRNA Sequence | B. burgdorferi | B. miyamotoi | RNase P |
|---|---|---|---|---|
| R0626 | UAAUUUCUACUAAGUGUAG AUCCGGAGCTTGGAACAGA CTC (SEQ ID NO: 18) | | | X |
| R0643 | UAAUUUCUACUAAGUGUAG AUAAGCUUCGCUUGUAGAU GAG (SEQ ID NO: 19) | X | X | |
| R0644 | UAAUUUCUACUAAGUGUAG AUACUUGCAUGCUUAAGAC GCA (SEQ ID NO: 20) | X | | |
| R0645 | UAAUUUCUACUAAGUGUAG AUAUCCUGGCUUAGAACUA ACG (SEQ ID NO: 21) | X | | |
| R0646 | UAAUUUCUACUAAGUGUAG AUAUUCGAUGAUACGCGAG GAA (SEQ ID NO: 22) | X | X | |
| R0647 | UAAUUUCUACUAAGUGUAG AUCAACAUAGGUCCACAGU UGA (SEQ ID NO: 23) | X | | |
| R0648 | UAAUUUCUACUAAGUGUAG AUCAACAUAGUUCCACAGU UGA (SEQ ID NO: 24) | X | | |
| R0649 | UAAUUUCUACUAAGUGUAG AUCAGCAUAGUUCCACAGU UGA (SEQ ID NO: 25) | | X | |

TABLE 5-continued

| Guide RNA | crRNA Sequence | B. burgdorferi | B. miyamotoi | RNase P |
|---|---|---|---|---|
| R0650 | UAAUUUCUACUAAGUGUAG AUCAGCGUACACUACCAGG GUA (SEQ ID NO: 26) | X | X | |
| R0651 | UAAUUUCUACUAAGUGUAG AUCCCUACCAACUAGCUAA UAA (SEQ ID NO: 27) | X | | |
| R0652 | UAAUUUCUACUAAGUGUAG AUCUACAAAGCUUAUUCCU CAU (SEQ ID NO: 28) | X | | |
| R0653 | UAAUUUCUACUAAGUGUAG AUGGGUCUAUAUACAGGUG CUG (SEQ ID NO: 29) | X | | |
| R0654 | UAAUUUCUACUAAGUGUAG AUGGGUCUGUAUACAGGUG CUG (SEQ ID NO: 30) | | X | |
| R0655 | UAAUUUCUACUAAGUGUAG AUGUGACUCAGCGUCAGUC UUG (SEQ ID NO: 31) | X | X | |
| R0656 | UAAUUUCUACUAAGUGUAG AUGUUAACACCAAGUGUGC AUC (SEQ ID NO: 32) | X | | |
| R0657 | UAAUUUCUACUAAGUGUAG AUUAGGAAAUGACAAAGCG AUG (SEQ ID NO: 33) | | X | |
| R0658 | UAAUUUCUACUAAGUGUAG AUUCAUUUCCUACAAAGCU UAU (SEQ ID NO: 34) | X | X | |
| R0659 | UAAUUUCUACUAAGUGUAG AUUGCAUAGACUUAUAUAU CCG (SEQ ID NO: 35) | X | | |
| R0660 | UAAUUUCUACUAAGUGUAG AUAGGUAUGUUUAGUGAGG GGG (SEQ ID NO: 36) | X | | |
| R0661 | UAAUUUCUACUAAGUGUAG AUGUGAGGGGGUGAAGUC GUA (SEQ ID NO: 37) | X | | |

The targets include double-stranded DNA gene fragments or PCR amplicon of gDNA. Borrelia targets include synthetic gene fragments of 16 S RNA genes of B. Burgdorferi and B. miyamotoi. Synthetic gene fragments were purchased from a third-party vendor. The gene fragments were amplified in PCR reactions. The amplicons were purified and quantified. A total of three targets were obtained. The two B. burgdorferi gene fragments have one base difference: B. miyamotoi* 16 S fragment, 1350 bp; *B. burgdorferi* 16 S fragment (guide 91 variant), 1607 bp; *B. burgdorferi* 16 S fragment (guide 92 variant), 1670 bp. The RNase P target was amplified from human gDNA and the length of the amplicon was 101 bp.

The Cas protein used in these experiments was Lba-Cas12a. The reporter was an 8-mer ssDNA with a FAM-labeled 5' end and an Iowa Black FQ-labeled 3' end.

Guide RNA (crRNA) was individually complexed with Lba-Cas12a protein at high concentration. Each crRNA was mixed at 3.2 uM with 3.2 uM of Lba-Cas12a in 1× MBuffer 2 (20 mM Tris HCl, pH8, 100 mM NaCl, 5 mM MgCl2, 1 mM DTT, 5% glycerol, 50 ug/mL Heparin). The concentrations of the crRNA and protein were at least 4-fold higher than those in the standard single guide complexing reaction. The mixture was incubated at 37° C. for 30 minutes to form the guide-protein complex. TABLE 6 below lists the formulation of the complexing reaction. The volumes are for one DETECTR reaction, and can be scaled up accordingly.

TABLE 6

| Component | Volume (μL) |
|---|---|
| 5X MBuffer 2 | 1 |
| crRNA (20 μM) | 0.8 |
| Lba-Cas12a (5 μM) | 3.2 |
| TOTAL | 5 |

Guide Pooling. At the completion of the incubation, guide pools were generated by combining equal volume of individual guide-protein complexing reactions. Several pools at different n-plex (n=number of different guides) levels were generated.

Pool 1 combined an equal volume of all 19 *Borrelia* guide-protein complexing reactions and the RNase P guide-protein complexing reaction. This produced a 20-plex pool where the protein concentration is 3.2 μM and the concentration of each guide was 160 nM Pool 2 combined equal volume of 10 *Borrelia* guide-protein complexing reactions (R0643-R0652). This produced a 10-plex pool where the protein concentration was 3.2 μM and the concentration of each guide is 320 nM. Pool 3 combined equal volume of 9 *Borrelia* guide-protein complexing reactions and the RNase P guide-protein complexing reaction (R0653-R0661, R0626). This produced a 10-plex pool where the protein concentration is 3.2 μM and the concentration of each guide was 320 nM. Pool 4 combined equal volume of 5 *Borrelia* guide-protein complexing reactions and the RNase P guide-protein complexing reaction (R0643-R0647, R0626). This produced a 6-plex pool where the protein concentration is 3.2 μM and the concentration of each guide was 533 nM. Pool 5 combined equal volume of 5 *Borrelia* guide-protein complexing reactions in pool 4 without the RNase P guide-protein complexing reaction (R0643-R0647). This produced a 6-plex pool where the protein concentration is 3.2 μM and the concentration of each guide was 640 nM. Pool 6 combined equal volume of 5 *B. burgdorferi* specific guide-protein complexing reactions and the RNase P guide-protein complexing reaction (R0645, R0647, R0659, R0660, R0661, R0626). This produced a 6-plex pool where the protein concentration is 3.2 μM and the concentration of each guide was 533 nM. Pool 7 was combined equal volume of 5 *B. burgdorferi* specific guide-protein complexing reactions in poo 16 without the RNase P guide-protein complexing reaction (R0645, R0647, R0659, R0660). This produced a 5-plex pool where the protein concentration is 3.2 μM and the concentration of each guide is 640 nM.

5 μl of the complexing reaction was used in each of the 20 μl DETECTR assays. The effective concentration in the assay of guides and protein is one fourth of those in the complexing reactions.

Complex Master Mix. Complex Master Mixes of the guide pools were completed by adding equal volume of Mix2 (containing the ssDNA reporter and additional buffer, the formulation is listed in TABLE 7).

TABLE 7

| Component | Volume (μL) |
|---|---|
| H2O | 0.8 |
| ssDNA reporter (10 uM) | 0.2 |
| 5x MBuffer 2 | 3 |
| Glycerol 80% | 1 |
| Total | 5 |

Additionally, Mix2 was added to individual guide-protein complexing reaction to generate single guide complex master mix. In the complex master mix, the concentrations of the guides and proteins were diluted in half.

DETECTR assay. The targets were diluted to 200 pM and 20 pM. In each DETECTR assay, 10 μl of complex master mix was mixed with 10 ul of sample in a well of a 384-well plate. The effective concentrations of the guides and protein were one fourth of those in the complexing reaction. The reaction was carried out in a TECAN Infinite 200 pro plate reader at 37° C. The fluorescence raw data file was analyzed using internal software. The kinetics of the DETECTR assay was measured by max_rate (estimated rate of cleavage of the reporter by the activated Cas protein). The activity of the guide pools versus the single guide was measured against 200 pM targets (100 pM targets in the final reaction. The max_rate of the DETECTR assay is summarized below in TABLE 8.

TABLE 8

| Row Labels | B. burgdorferi 16Sfrag (guide91var) | B. burgdorferi 16Sfrag (guide92var) | B. miyamotoi 16Sfrag | RNaseP8105 |
|---|---|---|---|---|
| Pool1 20plex | 1337 | 1326 | 1120 | 491 |
| Pool2 10plex | 1033 | 961 | 896 | 43 |
| Pool3 10plex | 939 | 1245 | 670 | 456 |
| Pool4 6plex | 908 | 857 | 577 | 380 |
| Pool5 5plex | 851 | 851 | 497 | 22 |
| Pool6 6plex | 687 | 649 | 25 | 425 |
| Pool7 5plex | 701 | 697 | 39 | 27 |
| R0626 | 33 | 31 | 48 | 364 |
| R0643 | 406 | 389 | 409 | 29 |
| R0644 | 285 | 252 | 168 | 29 |
| R0645 | 336 | 339 | 40 | 38 |
| R0646 | 294 | 318 | 274 | 34 |
| R0647 | 319 | 141 | 131 | 50 |
| R0648 | 212 | 297 | 291 | 38 |
| R0649 | 221 | 328 | 321 | 31 |
| R0659 | 309 | 310 | 32 | 25 |
| R0660 | 442 | 414 | 29 | 41 |
| R0661 | 189 | 183 | 38 | 34 |

Figures 23A, 23B:
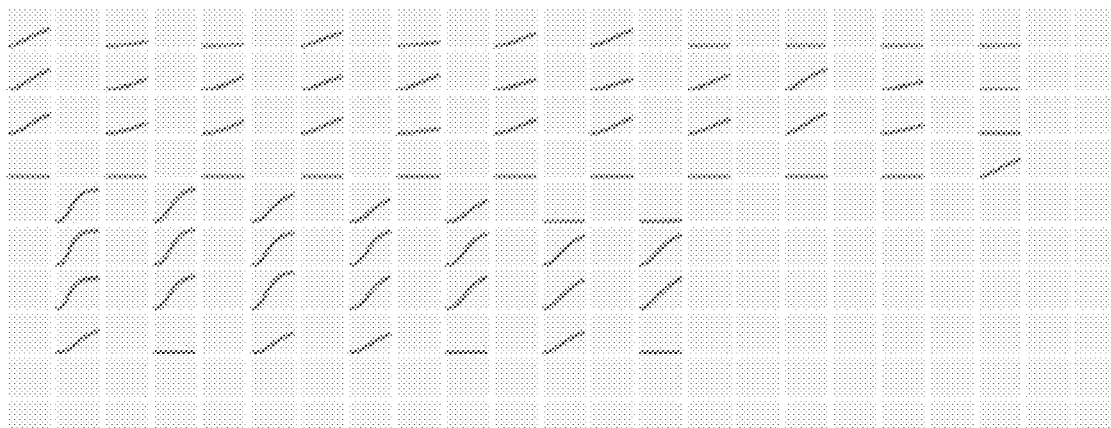
FIG. 23A shows a plate reader image of a results summarized in TABLE 8.
FIG. 23B shows the plate layout corresponding to FIG. 23A.

The data showed that signals were clearly boosted by guide pooling. The signals of the 5/6-plex Pool 4, Pool 5, Pool 6, and Pool 7 were two to three times higher than a single guide assay. The signal increased as the n-plex level was increased to 10- and 20-plex and the detection sensitivity was improved from the single guide detection. The results were more evident for the B. miyamotoi detection. Pool 6 and Pool 7 had no miyamotoi specific guides and generated no signals. As more miyamotoi guides are added to the guide pool, the signal for B. miyamotoi improved to the levels of those for B. burgdorferi targets. The guide pools can be adjusted to detect different targets, B. burgdorferi only, B. burgdorferi plus B. miyamotoi, or B. burgdorferi plus B, miyamotoi plus human RNase P. FIG. 23A shows a plate reader image of results summarized in TABLE 8. FIG. 23B shows the plate layout corresponding to FIG. 23A.

The activities of the guide pools were also measured against 20 pM targets (10 pM in the final reaction and the results are shown below in TABLE 9.

TABLE 6

| Pool | Target coc (10 pM) | B. burgdorferi 16Sfrag (guide91var) | B. burgdorferi 16Sfrag (guide92var) | B. miyamotoi 16Sfrag |
|---|---|---|---|---|
| Pool1 20plex | 100 | 2076 | 1686 | 1705 |
|  | 10 | 301 | 331 | 317 |
| Pool2 10plex | 10 | 200 | 225 | 253 |
| Pool3 10plex | 10 | 177 | 224 | 139 |

Figures 24A, 24B:
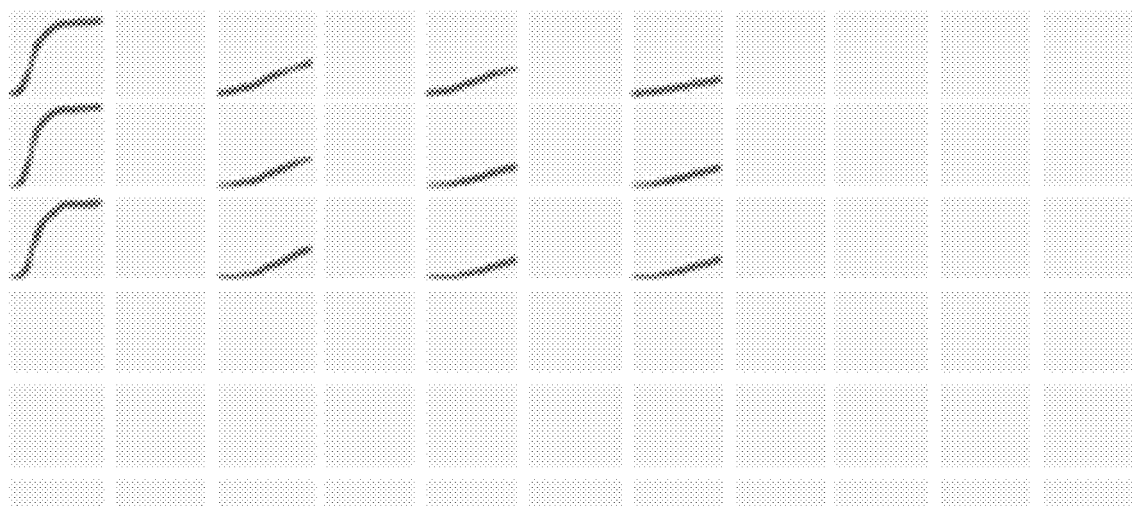
FIG. 24A shows a plate reader image of a results summarized in TABLE 9.
FIG. 24B shows the plate layout corresponding to FIG. 24A.

Results showed that the detection of 10 pM targets, which is near the detection limit of the single guide assay, was improved and the pooling of the guides improved the sensitivity of the assay. FIG. 24A shows a plate reader image of a results summarized in TABLE 9. FIG. 24B shows the plate layout corresponding to FIG. 24A.

Figure 22A:
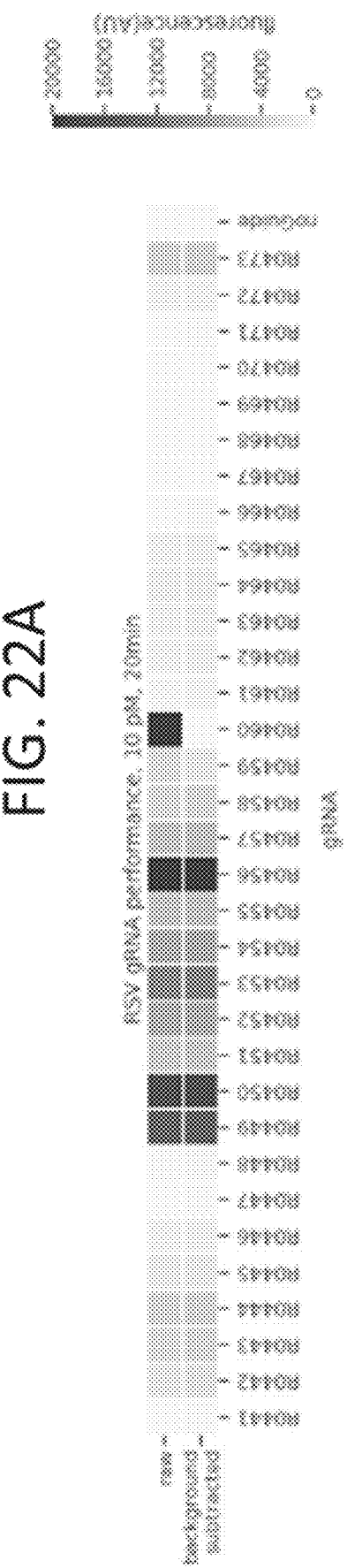
FIG. 22A shows a panel of gRNAs for RSV evaluated for detection efficiency. Darker squares in the background subtracted row indicate greater efficiency of detecting RSV target nucleic acids.
Figure 22B:
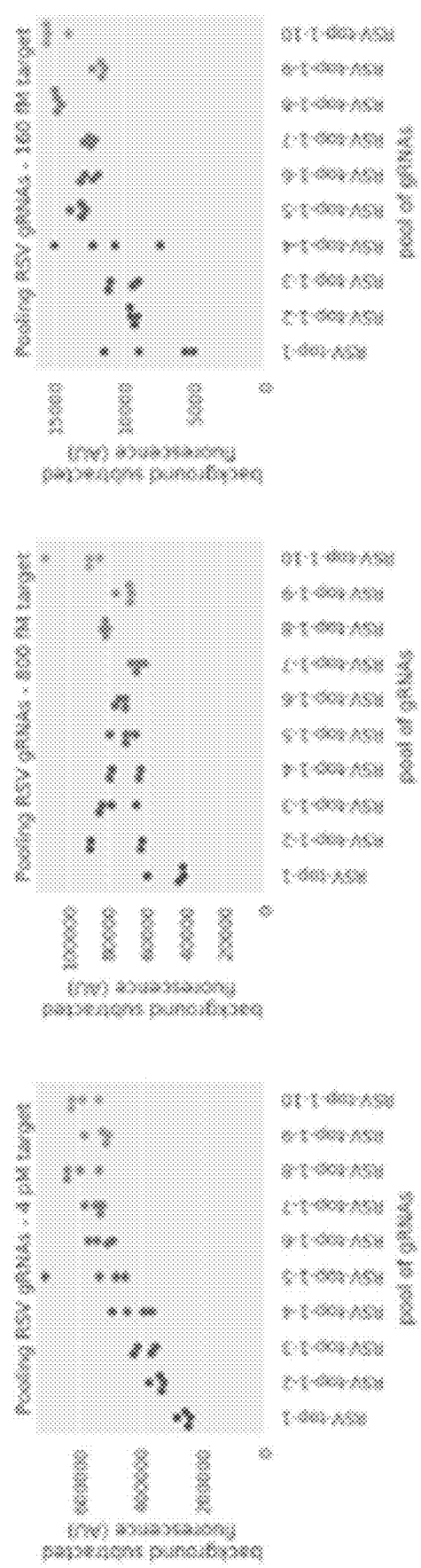
FIG. 22B shows graphs of pools of gRNA versus background subtracted fluorescence.

B. Guide Pooling Top-Performing Individual gRNAs to Increase Assay Sensitivity for Detection of RSV Guide pooling was used to improve the detection limit of an assay for RSV detection. 33 guide RNAs for RSV guides were designed by tiling across the target region. The guide RNAs were screened for activities and top performing guides were selected for pooling. RNA corresponding to the RSV target was generated from in vitro transcription (IVT) reaction. A Cas13a protein was used and the reporter was a 5-mer ssRNA with a 5' FAM and a 3' Iowa Black FQ. FIG. 22A shows a panel of gRNAs for RSV evaluated for detection efficiency. Darker squares in the background subtracted row indicate greater efficiency of detecting RSV target nucleic acids. FIG. 22B shows graphs of pools of gRNA versus background subtracted fluorescence. The left most graph shows pooling of RSV gRNAs for detection of 4 pM of target nucleic acids. The middle graph shows pooling of RSV gRNAs for detection of 800 fM of target nucleic acids. The right most graph shows pooling of RSV gRNAs for detection of 160 fM of target nucleic acids. gRNA sequences used in the RSV study are summarized below in TABLE 10.

TABLE 10

| Guide name | SEQ ID NO | crRNA Sequence |
|---|---|---|
| R0443 | SEQ ID NO: 38 | GCCACCCCAAAAAUGAAGGGGACUA AAACAUCCUACAAAAAAAUGCUAAA |
| R0444 | SEQ ID NO: 39 | GCCACCCCAAAAAUGAAGGGGACUA AAACACCUACAAAAAAAUGCUAAAA |
| R0445 | SEQ ID NO: 40 | GCCACCCCAAAAAUGAAGGGGACUA AAACACUACAAAAAAAUGCUAAAAG |
| R0449 | SEQ ID NO: 41 | GCCACCCCAAAAAUGAAGGGGACUA AAACAAGAAACAUUUGAUAACAAUG |
| R0450 | SEQ ID NO: 42 | GCCACCCCAAAAAUGAAGGGGACUA AAACAGAAACAUUUGAUAACAAUGA |
| R0452 | SEQ ID NO: 43 | GCCACCCCAAAAAUGAAGGGGACUA AAACAAACAUUUGAUAACAAUGAAG |
| R0453 | SEQ ID NO: 44 | GCCACCCCAAAAAUGAAGGGGACUA AAACAACAUUUGAUAACAAUGAAGA |

TABLE 10-continued

| Guide name | SEQ ID NO | crRNA Sequence |
|---|---|---|
| R0456 | SEQ ID NO: 45 | GCCACCCCAAAAAUGAAGGGGACUA AAACAUGCCUAUAACAAAUGAUCAG |
| R0457 | SEQ ID NO: 46 | GCCACCCCAAAAAUGAAGGGGACUA AAACAGCCUAUAACAAAUGAUCAGA |

Example 32

Optimization of Temperature and Temperature Tolerance of Programmable Nucleases in Diagnostics This example describes optimization of temperature and temperature tolerance of a programmable nuclease for use in a diagnostic. Here, CRISPR-Cas proteins were used as the programmable nuclease, and these CRISPR-Cas proteins were used in CRISPR diagnostics. The CRISPR diagnostics of the present disclosure leverage the unique biochemical properties of Type V (e.g., Cas12) and Type VI (e.g., Cas13) CRISPR-Cas proteins to enable the specific detection of nucleic acids. These proteins are directed to their target nucleic acid by a CRISPR RNA (crRNA), which is also known as a guide RNA (gRNA). Once bound to a complementary target sequence, the Cas protein initiates indiscriminate cleavage of surrounding single-strand DNA or single-strand RNA. When coupled to a quenched fluorescence reporter or other cleavage reporter, fluorescent or other signal can be generated by the Cas protein only in the presence of the target nucleic acid. CRISPR-Cas proteins have been isolated from a variety of natural contexts and therefore have different tolerances for elevated temperatures and optimal temperature ranges. These different tolerances for temperature can be used to activate or inhibit the proteins at different stages to allow for other molecular processes, such as target amplification, to occur.

Cas12M08 (a variant within the Cas12 family), Lba-Cas12a, and Cas13M26 (Lbu-Cas13a) were incubated at 25° C., 30° C., 35° C., 40° C., 45° C., and 50° C. with a target nucleic acid. Detection assays using the various Cas proteins were set up using 1 nM DNA target for Cas12 proteins and 25 pM RNA target for Cas13a. The max_rate (fluorescence units/2 min) was determined for evaluating the efficiency of the proteins at various temperatures.

Figure 25:
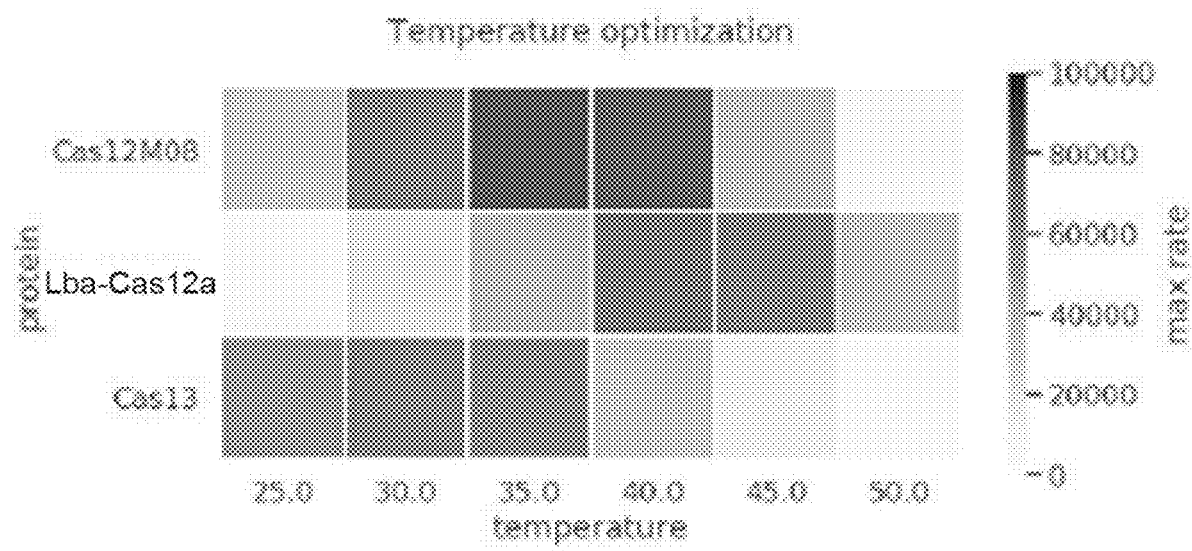
FIG. 25 shows that the functional range for the Type V protein Cas12M08 (a variant within the Cas12 family having a sequence of SEQ ID NO: 155 is between 25° C. and 45° C., with maximal activity at 35° C.

FIG. 25 shows that the functional range for the Type V protein Cas12M08 is between 25° C. and 45° C., with maximal activity at 35° C. For the Type V protein Lba-Cas12a the functional range is from 35° C. to 50° C. with peak activity around 40° C. For the Type VI protein Cas13M26 (Lbu-Cas13a) the functional range is between 25° C. and 40° C. with maximal activity between 30° C. and 35° C. Darker squares indicate a higher max_rate and more efficient activity. As suggested in FIG. 25, it appears that Type V proteins, such as Cas12M08 and Lba-Cas12a, may be stable and functional at elevated temperatures. To test how stable each of these proteins are, proteins were incubated for 15 minutes at 45° C., 50° C., 55° C., 60° C., 65° C., or 70° C. and then decreased the reaction temperature to 37° C.

Figure 26:
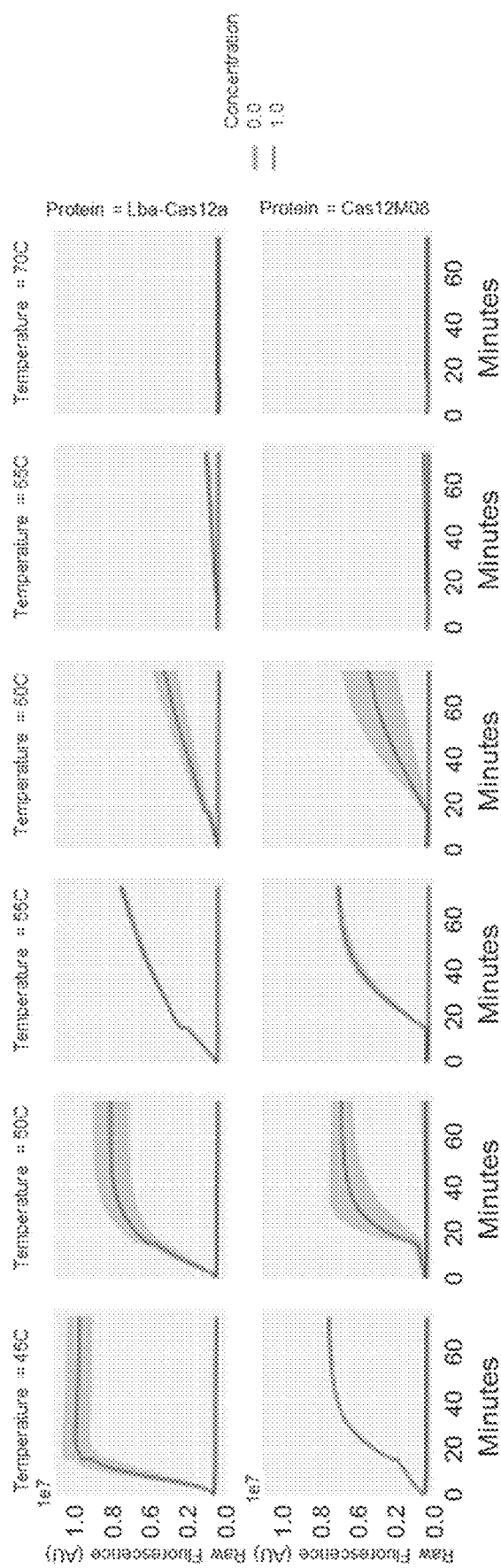
FIG. 26 shows the results of incubating Cas12 proteins for 15 minutes at 45° C., 50° C., 55° C., 60° C., 65° C., or 70° C. and then decreasing the reaction temperature to 37° C.

FIG. 26 shows the results of incubating Cas12 proteins for 15 minutes at 45° C., 50° C., 55° C., 60° C., 65° C., or 70° C. and then decreasing the reaction temperature to 37° C. Lba-Cas12a was found to be functional even after incubation at 65° C. Cas12M08 was found to have no activity while at temperatures above 50° C., but after lowering the temperature to 37° C., the enzymatic activity of the protein returned. This temperature shifting may be exploitable for use in isothermal amplification methods, where the amplification occurs at a higher temperature, but after lowering the reaction temperature the Cas protein can be activated without compromising its functionality.

FIG. 27 shows that the stability of Cas12M08 at elevated temperatures is dependent on the buffer composition. Cas12M08 stability was assessed after exposure to elevated temperatures for 30 minutes and then lowering the reaction temperature to 37° C. A variety of buffers were tested to determine their impact on the ability to turn Cas12M08 on and off based on the reaction temperature. 0.5× NEBuffer4 (New England Biolabs)+0.05% Tween gave the best results, followed by 1× MBuffer3. 0.5× of Isothermal Amplification (IsoAmp) buffer (New England Biolabs) inhibited the Cas12M08 reaction completely.

Example 33

Sample Preparation Protocol and Device Workflow

This example describes sample preparation protocol and device workflow. Collecting and processing material for diagnostic analysis is typically performed at a point of care facility or a clinical laboratory. There are minimal methods currently available for at home sample collection and nucleic acid extraction for diagnostic analysis. The devices disclosed herein provide an over the counter solution for nucleic acid extraction with or without nucleic acid amplification and with or without a reaction comprising a programmable nuclease, guide nucleic acid, and a reporter, such as the DETECTR reaction. The resulting products from any or all of these modules are applied to a readout device for data collection and subsequent analysis.

A crude sample preparation protocol includes elution of a sample from a sample collection device (e.g. swab) into a buffer that will induce dissociation of the sample into its macromolecule components releasing the genomic nucleic acids. Buffer conditions used to induce the dissociation include any or all of the following: pH change, chaotropic salts and a detergent (Tween 20, Triton X-100, Deoxycholate, Sodium laurel sulfate or CHAPS. This protocol occurs in a stepwise work flow that would feed into a hand held device. In this device there is at least one chamber that contains the reagents components for the sample preparation protocol.

FIG. 28 shows individual parts of sample preparation devices of the present disclosure. Part A of the figure shows a single chamber sample extraction device: (a) the insert holds the sample collection device and regulates the step between sample extraction and dispensing the sample into another reaction or detection device, (b) the single chamber contains extraction buffer. Part B of the figure shows filling the dispensing chamber with material that further purifies the nucleic acid as it is dispensed is an option: (a) the insert holds the sample collection device and regulates the "stages" of sample extraction and nucleic acid amplification. Each set of notches (red, blue and green) are offset 90° from the preceding set, (b) the reaction module contains multiple chambers separated by substrates that allow for independent reactions to occur. (e.g., i. a nucleic acid separation chamber, ii. a nucleic acid amplification chamber and iii. a DETECTR reaction chamber or dispensing chamber). Each chamber has notches (black) that prevent the insert from progressing into the next chamber without a deliberate 90° turn. The first two chambers may be separated by material that removes inhibitors between the extraction and amplification reactions. Part C shows options for the reaction/dispensing chamber: (a) a single dispensing chamber may release only extracted sample or extraction/amplification or extraction/amplification/DETECTR reactions, (b) a duel dispensing chamber may release extraction/multiplex amplification products, and (c) a quadruple dispensing chamber would allow for multiplexing amplification and single DETECTR or four single amplification reactions.

FIG. 29 shows a sample work flow using a sample processing device. The sample collection device is attached to the insert portion of the sample processing device (A). The insert is placed into the device chamber and pressed until the first stop (lower tabs on top portion meet upper tabs on bottom portion) (B). This step allows the sample to come into contact with the nucleic acid extraction reagents. After the appropriate amount of time, the insert is turned 90° (C) and depressed (D) to the next set of notches. These actions transfer the sample into the amplification chamber. The sample collection device is no longer in contact with the sample or amplification products. After the appropriate incubation, the insert is rotated 90° (E) and depressed (F) to the next set of notches. These actions release the sample into the DETECTR (green reaction). The insert is again turned 90° (G) and depressed (H) to dispense the reaction.

Examples of crude sample preparation protocols are summarized in TABLE 11.

TABLE 11

| Name | Sample | HCl | Detergent | Urea | Incubation time | Incubation temperature |
|---|---|---|---|---|---|---|
| Low pH | Clinical reminant | Yes | N/A | No | 15 minutes | RT |
| Low pH + heat | Clinical reminant | Yes | N/A | No | 15 minutes | 60° C. |
| Deoxycholate | Clinical reminant | No | Yes | No | 15 minutes | RT |
| Deoxycholate + heat | Clinical reminant | No | Yes | No | 15 minutes | 60° C. |
| CHAPS | Clinical reminant | No | Yes | No | 15 minutes | RT |
| CHAPS + heat | Clinical reminant | No | Yes | No | 15 minutes | 60° C. |
| Deoxycholate + Urea | Clinical reminant | No | Yes | Yes | 15 minutes | RT |
| Deoxycholate + Urea + heat | Clinical reminant | No | Yes | Yes | 15 minutes | 60° C. |
| CHAPS + Urea | Clinical reminant | No | Yes | Yes | 15 minutes | RT |
| CHAPS + Urea + heat | Clinical reminant | No | Yes | Yes | 15 minutes | 60° C. |
| NucleoSpin Control | Clinical reminant | No | Yes | Yes | 3 minutes | RT |

FIG. 30 shows extraction buffers used to extract Influenza A RNA from remnant clinical samples. Replicate remnant clinical samples were exposed to the reagents listed in TABLE 11 above. The extraction process was completed using the NucleoSpin Virus kit. qPCR analysis was performed to evaluate the quality and quantity of extracted RNA genome. The low pH condition resulted in RNA amounts equal to the sample extracted with the 'gold standard' kit (RT-pool).

FIG. 31 shows that low pH conditions allow for rapid extraction of Influenza A genomic RNA. Decreasing time of exposure to low pH conditions did not affect the efficiency of viral dissociation and subsequent extraction completed using the NucleoSpin Virus kit. The amount of extracted product was similar to the 'gold standard' extractions (RT-pool).

Example 34

Isothermal Amplification in CRISPR-Cas Diagnostics

This example describes methods of isothermal amplification in the programmable nuclease diagnostics of the present disclosure. Here, CRISPR-Cas diagnostics were used as programmable nuclease diagnostics of the present disclosure, including those diagnostics involving DETECTR assays. CRISPR diagnostics leverage the unique biochemical properties of Type V (e.g. Cas12) and Type VI (e.g. Cas13) CRISPR-Cas proteins to enable the specific detection of nucleic acids. These proteins are directed to their target nucleic acid by a CRISPR RNA (crRNA), which is also known as a guide RNA (gRNA). Once bound to a complementary target sequence, the Cas protein initiates indiscriminate cleavage of surrounding single-strand DNA or single-strand RNA. When coupled to a quenched fluorescence reporter or other cleavage reporter, fluorescent or other signal can be generated by the Cas protein only in the presence of the target nucleic acid. Alone these proteins are capable of detecting in the pM or fM range of target nucleic acid. When coupled to nucleic acid amplification set forth in this example and disclosed elsewhere herein, the sensitivity of CRISPR diagnostics was increased to the aM or zM range. PCR is a commonly used nucleic acid amplification method that generates double stranded DNA (dsDNA) when temperatures are cycled between two or three different temperatures. Nucleic acid amplification methods that function at single temperature are known as isothermal amplification. These methods include loop-mediated isothermal amplification (LAMP), recombinase polymerase amplification (RPA), strand invasion based amplification (SIBA), strand displacement amplification (SDA), and nucleic acid sequence based amplification (NASBA). These methods can be coupled to reverse transcription (RT) which enables these methods to amplify RNA targets by first converting the RNA to cDNA through reverse transcription.

CRISPR based diagnostics using Type V (e.g., Cas12) and CasVI (e.g., Cas13) proteins were run using isothermal amplification methods of target nucleic acids to enable sensitive diagnostic assays.

RPA. Recombinase polymerase amplification (RPA) was used to amplify DNA sequences or RNA sequences by including a reverse transcription enzyme in the reaction (RT-RPA). RPA and RT-RPA can be used to generate an amplicon suitable for detection by Type V (e.g. Cas12) Cas proteins.

Figure 32:
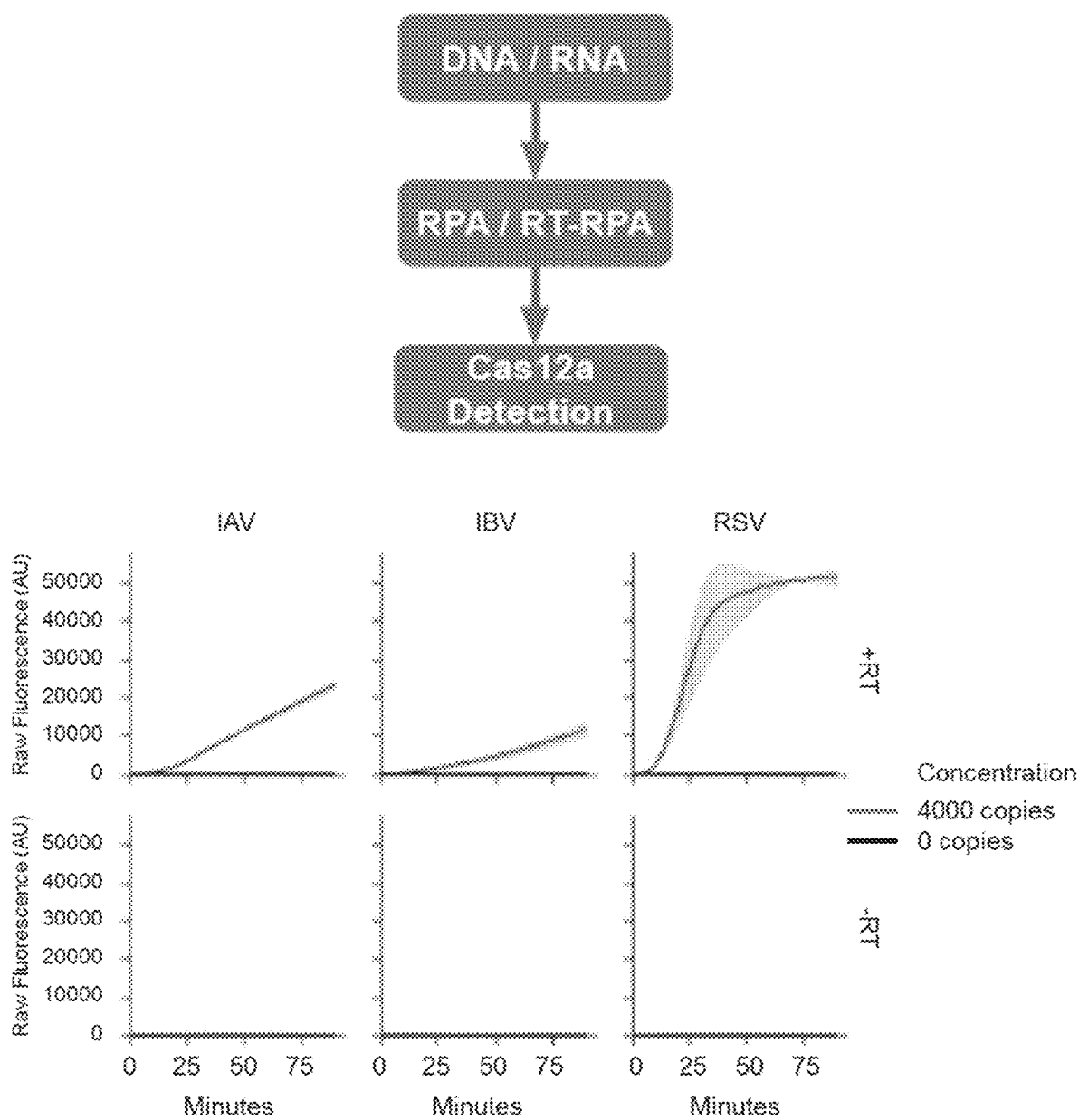
FIG. 32 shows the application of RT-RPA to the detection of Influenza A, Influenza B, and human Respiratory Syncytial Virus (RSV) viral RNA by Cas12a. The schematic at left shows the workflow including providing DNA/RNA, RPA/RT-RPA, and Cas12a detection. The graphs at right show the results of Cas12a detection as measured by fluorescence over time.

FIG. 32 shows the application of RT-RPA to the detection of Influenza A, Influenza B, and human Respiratory Syncytial Virus (RSV) viral RNA by Cas12a. A DNA or RNA sequence was amplified using RPA or RT-RPA prior to detection. By including a T7 promoter on one of the RPA primers, an in vitro transcription (IVT) reaction using an RNA polymerase to convert RNA to DNA step was performed after the RPA reaction to generate target RNA for detection by Type VI (e.g. Cas13) proteins. In FIG. 32, detection of RT-RPA amplicon was carried out from 4000 copies of Influenza A (IAV), Influenza B (IBV), and human respiratory syncytial virus (RSV) RNA using Cas12a. The RT-RPA reaction was performed at 40° C. for 30 minutes. Controls included no RT enzyme, no target control, and no primer control. Following the RT-RPA reaction, the RT-RPA amplicon was transferred to a Cas12a DETECTR assay.

Figure 33:
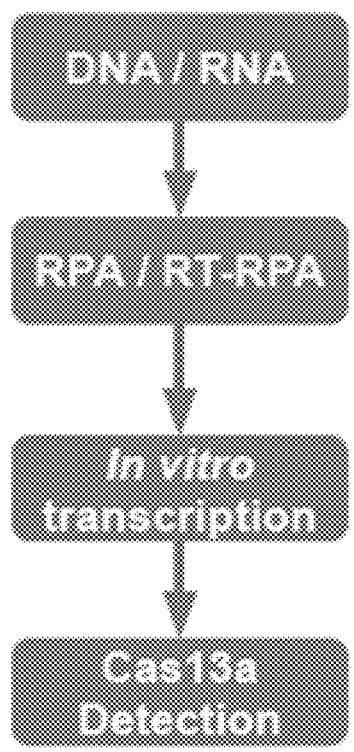
FIG. 33 shows the application of RT-RPA coupled with an IVT reaction enabling detection of viral RNA using Cas13a. The schematic at left shows the workflow including providing DNA/RNA, RPA/RT-RPA, in vitro transcription, and Cas13a detection. The graph at right shows the results of Cas13a detection as measured by fluorescence for each tested condition.
Figure 33:
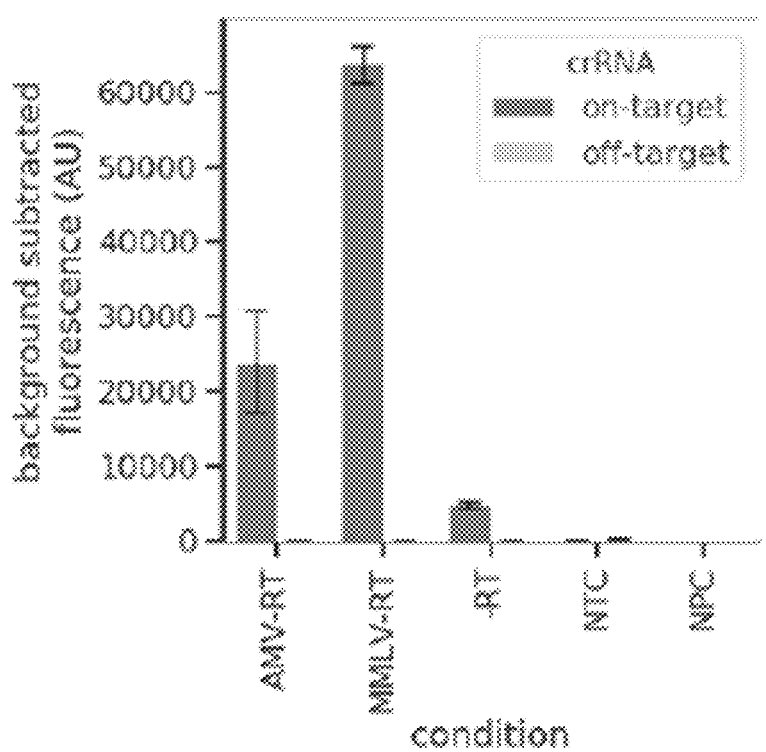

FIG. 33 shows the application of RT-RPA coupled with an IVT reaction enabling detection of viral RNA using Cas13a. In FIG. 33, detection of RT-RPA amplicon was carried out from 2 fM of PPR virus RNA using Cas13a. The RT-RPA reaction was performed at 40° C. for 30 minutes. Several reverse transcriptase enzymes were evaluated for their compatibility with the RPA reaction. Controls included no RT enzymes, no target, and no primers. Following the RT-RPA reaction, the RT-RPA amplicon was transferred to an IVT reaction for generation of RNA at 37° C. for 10 minutes. The product of the IVT reaction was diluted and added to a Cas13a reaction at 37° C. On-target and off-target crRNAs were used to demonstrate specificity of the Cas13a reaction.

Figure 34:
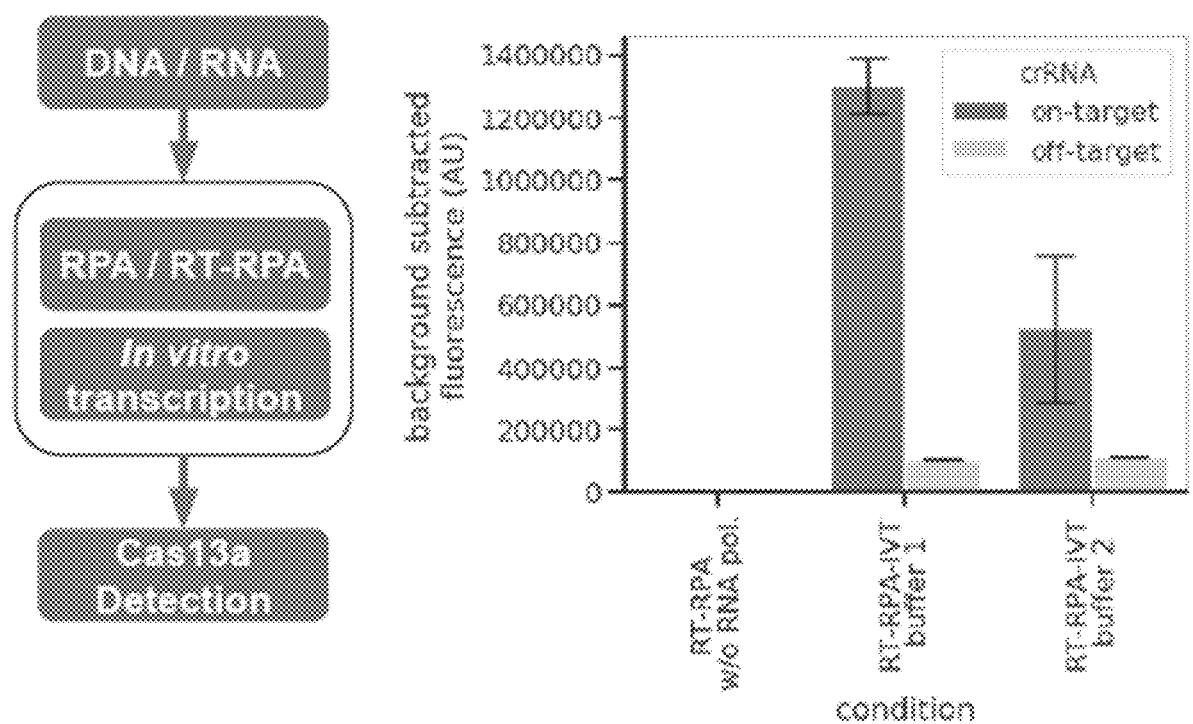
FIG. 34 shows the production of RNA, as detected by Cas13a, from an RNA virus using an RT-RPA-IVT "two-pot" reaction. The schematic at left shows the workflow including providing DNA/RNA, RPA/RT-RPA and in vitro transcription in a first reaction, and Cas13a detection in a second reaction. The graph at right shows the results of Cas13a detection as measured by fluorescence for each tested condition.

A "two-pot" DETECTR assay was carried out using RPA and Cas13a by combining the IVT reaction with the RT-RPA or RPA reaction to generate RNA simultaneously with the RPA reaction. FIG. 34 shows the production of RNA, as detected by Cas13a, from an RNA virus using an RT-RPA-IVT "two-pot" reaction. In the two-pot reaction, the first reaction was the RT-RPA-IVT, and the second reaction as the Cas13a detection assay. Components of the IVT (T7 RNA polymerase, NTPs) were added to a RT-RPA reaction in the presence of RNA transcription buffer (RPA rehydration buffer from Twist Dx "buffer 1") or RPA rehydration buffer (20 mM imidazole, pH 7.5; 50 mM KCl; 5 mM MgCl2; BSA 10 µg/mL; 0.01% Igepal Ca-630; 5% glycerol "buffer 2"). As a control, RT-RPA without the RNA polymerase was added. 2 fM of PPR virus RNA was used as the target RNA in these reactions. The reaction proceeded for 15 minutes at 37° C. and on-target and off-target crRNAs were used to show specificity.

Figure 35:
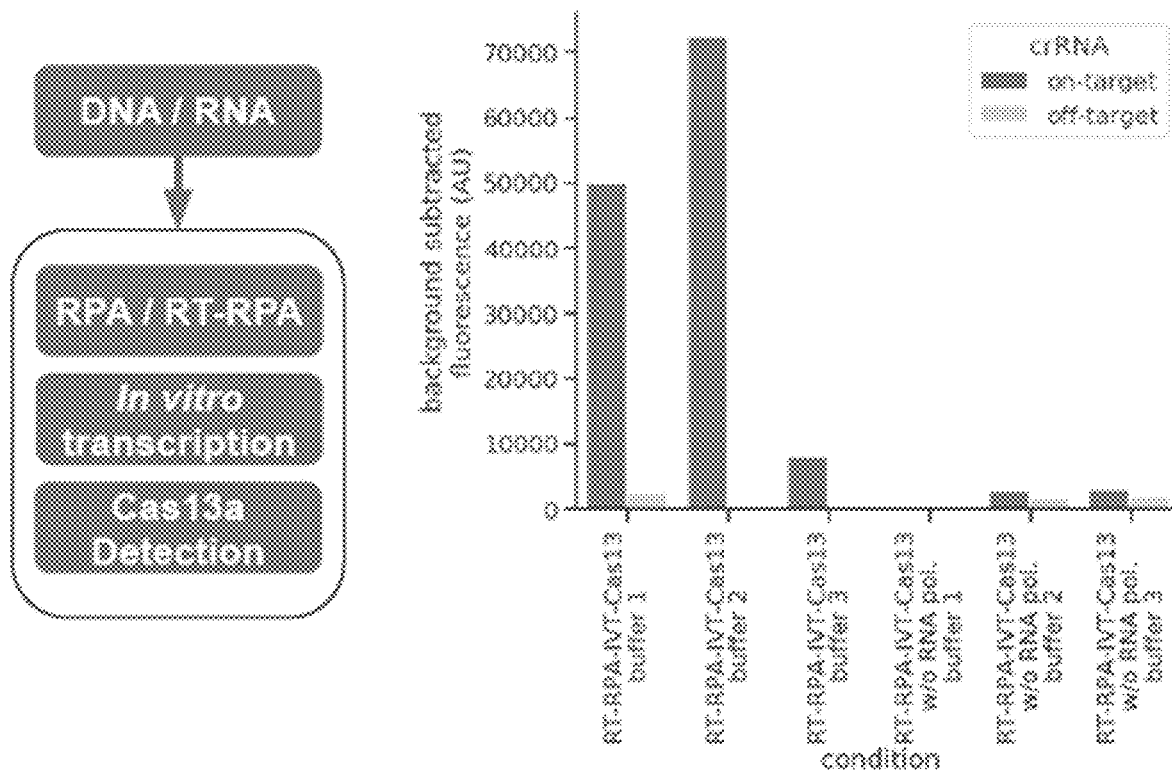
FIG. 35 shows the effect of various buffers on the performance of a one-pot Cas13a assay. The schematic at left shows the workflow including providing DNA/RNA and RPA/RT-RPA, in vitro transcription, and Cas13a detection. The graph at right shows the results of Cas13a detection as measured by fluorescence for each tested condition.

The IVT and Cas13a detection assay reactions were combined with RT-RPA or an RPA reaction to generate and detect RNA simultaneously in a "one-pot" assay. FIG. 35 shows the effect of various buffers on the performance of a one-pot Cas13a assay. Components for RT-RPA were combined in a single reaction with both components for IVT (T7 RNA polymerase, NTPs) and Cas13a detection (Cas13a enzyme, crRNA, fluorescent cleavage reporter). The reaction was run in three buffers (buffer 1: RPA rehydration buffer, buffer 2: Cas13a buffer, and buffer 3: Cas12a buffer (20 mM Tris-HCl, pH 8.0; 100 mM NaCl; 5 mM MgCl2; 1 mM DTT; 5% glycerol; 50 µg/mL heparin)). Reactions without the RNA polymerase were used as controls. In addition, specificity was shown by comparing a reaction with an on-target crRNA to a reaction with an off-target crRNA. The reaction was allowed to proceed at 40° C. for 10 minutes.

FIG. 36 shows the specific detection of viral RNA from the PPR virus that infects goats using the one-pot Cas13a assay. 500 aM of viral RNA was added to the reaction and the reaction was incubated at 40° C. As a control, an identical reaction without the T7 RNA polymerase ("PPRV-noIVT"; graph at right) was used to show the specific production of RNA for Cas13a to detect. An on-target and off-target crRNA was used to demonstrate assay specificity.

Figure 37:
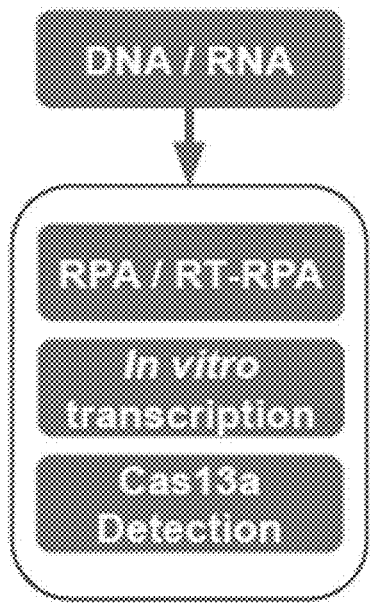
FIG. 37 shows the specific detection of Influenza B using the one-pot Cas13a assay run at 40° C. 40 fM of viral RNA was added to the reaction. The schematic at left shows the workflow including providing DNA/RNA and RPA/RT-RPA, in vitro transcription, and Cas13a detection. The graphs at right show the results of Cas13a detection as measured by fluorescence for each tested condition.
Figure 37:
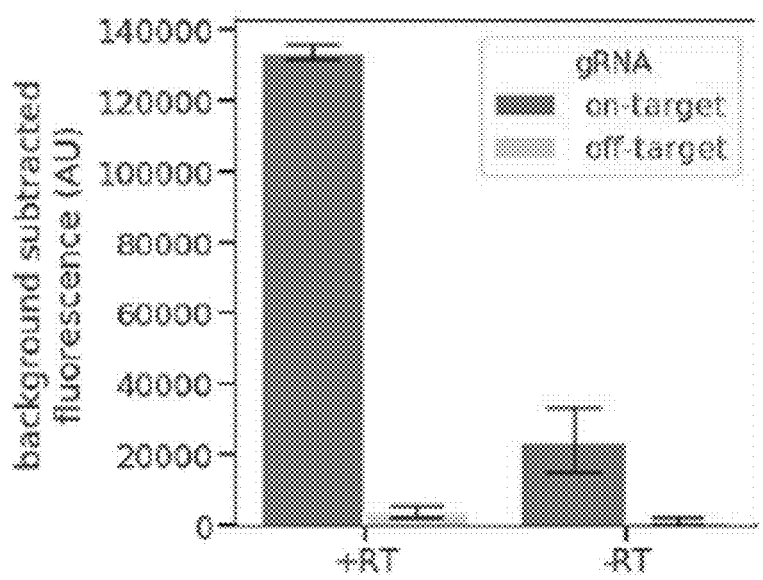

FIG. 37 shows the specific detection of Influenza B using the one-pot Cas13a assay run at 40° C. Reagents for RPA or RT-RPA, in vitro transcription, and Cas13a detection were combined in a single reaction. 40 fM of viral RNA was added to the reaction. As a control, an identical reaction without reverse transcriptase (labeled "−RT") was used to show the specific production of RNA for Cas13a to detect. An on-target and off-target crRNA was used to demonstrate assay specificity.

FIG. 38 shows the tolerance of the one-pot Cas13a assay for the detection of RNA from the Influenza B virus in the presence and in the absence of a universal viral transport medium called universal transport media (UTM Copan) at 40° C. Reagents for RPA or RT-RPA, in vitro transcription, and Cas13a detection were combined in a single reaction. 40 fM of viral RNA was added to the reaction. As a control, an identical reaction without reverse transcriptase (−RT) was used to show the specific production of RNA for Cas13a to detect. An on-target and off-target crRNA was used to demonstrate assay specificity.

FIG. 39 shows the one-pot Cas13a detection assay at various temperatures. FIG. 39A shows a schematic of the workflow including providing DNA/RNA and the one-pot reaction including RPA/RT-RPA, in vitro transcription, and Cas13a detection. Reagents for RPA or RT-RPA, in vitro transcription, and Cas13a detection were combined in a single reaction. FIG. 39B shows a graph of Cas13a detection of Influenza A RNA at various temperatures. FIG. 39C shows a graph of Cas13a detection of Influenza B RNA at various temperatures. FIG. 39D shows a graph of Cas13a detection of human RSV (FIG. 39D) RNA at various temperatures. 100,000 viral genomes were added to the reaction and compared to reactions containing 0 copies. Reactions were run at either 30° C., 32.5° C., 35° C., 37.5° C., or 40° C. The assay was determined to be most robust between 35° C. and 37.5° C.

LAMP. Loop-mediated isothermal amplification (LAMP) was also used for amplifying a DNA sequences or RNA sequences in combination with a reverse transcriptase enzyme (RT-LAMP). LAMP reactions use a combination of four, five, or six primers to amplify the target DNA or cDNA from RNA. During the course of the LAMP reaction, concatemers of amplicons form. If RT-LAMP or LAMP amplicons contain sequence features that support Cas protein recognition (such as PAM or PFS), they can be used as target nucleic acids in CRISPR diagnostics.

FIG. 40 shows the optimization of a LAMP reaction for the detection of an internal amplification control using a DNA sequence derived from the Mammuthus *primigenius* (Wooly Mammoth) mitochondria. In addition, FIG. 40 shows the specific detection of the LAMP amplicon by Cas12a using a variety of crRNAs. FIG. 40A shows a schematic of the workflow including providing DNA/RNA, LAMP/RT-LAMP amplification, and Cas12a detection. FIG. 40B shows the time to result for LAMP reactions for an internal amplification control using a DNA sequence derived from the Mammuthus *primigenius*, as quantified by fluorescence. The time to result was determined by the time to reach half of max fluorescence for a reaction. Controls include off-target Hela genomic DNA and a no target control. FIG. 40C shows Cas12a specific detection at 37° C. of LAMP amplicon from the 68° C. temperature reaction. Two on-target crRNAs were tested. Specificity was shown by no detection from Hela genomic DNA amplicon or no template control (NTC) amplicon.

FIG. 41 shows the optimization of LAMP and Cas12 specific detection of the human POP7 gene that is a component of RNase P. This sequence is present in human DNA and RNA and was used as a control for the efficiency of sample extraction (sample control). FIG. 41A shows a schematic of the workflow including providing DNA/RNA, LAMP/RT-LAMP amplification, and Cas12a detection. FIG. 41B shows the time to result of a LAMP/RT-LAMP reaction for RNase P POP7 at different temperatures, as quantified by fluorescence. Time to result was determined by the time to reach half of max fluorescence for a reaction. Controls included off-target mouse-liver-RNA and a no target control. Hela total RNA and Hela genomic RNA were detected by the RT-LAMP and LAMP reactions, respectively. FIG. 41C shows three graphs demonstrating Cas12a specific detection at 37° C. of LAMP/RT-LAMP amplicon from the 68° C. temperature reaction. Two on-target crRNAs were tested and one off-target crRNA was tested. Specificity was shown by no detection of mouse total RNA amplicon or no template control (NTC) amplicon.

Cas12 was also used for the detection of RT-LAMP products. FIG. 42 shows the specific detection of three different RT-LAMP amplicons for Influenza A virus. The data from this experiment shows that the design of RT-LAMP primers around Cas12a compatible sites was important for the specificity of the experiment. The primer and crRNA were optimized and combined for specific detection of Influenza A (IAV) amplified by RT-LAMP. Briefly, three different primer sets were tested for use in RT-LAMP reactions that were specific to IAV. RT-LAMP reactions were performed either in the presence of IAV RNA or as a control with no template (NTC). For each amplicon, two on-target crRNAs and one off-target crRNA was used in a Cas12a detection assay at 37° C.

FIG. 43 shows the identification of optimal crRNAs for the specific detection of Influenza B (IBV) RT-LAMP amplicons. The RT-LAMP reaction was performed for 30 minutes at 60° C. in the presence of Influenza A (IAV) RNA, IBV RNA, or a no template control (NTC). For the resulting amplicons, three on-target crRNAs were used to determine which was most specific and efficient for the detection of Influenza B by Cas12a at 37° C.

Figure 44:
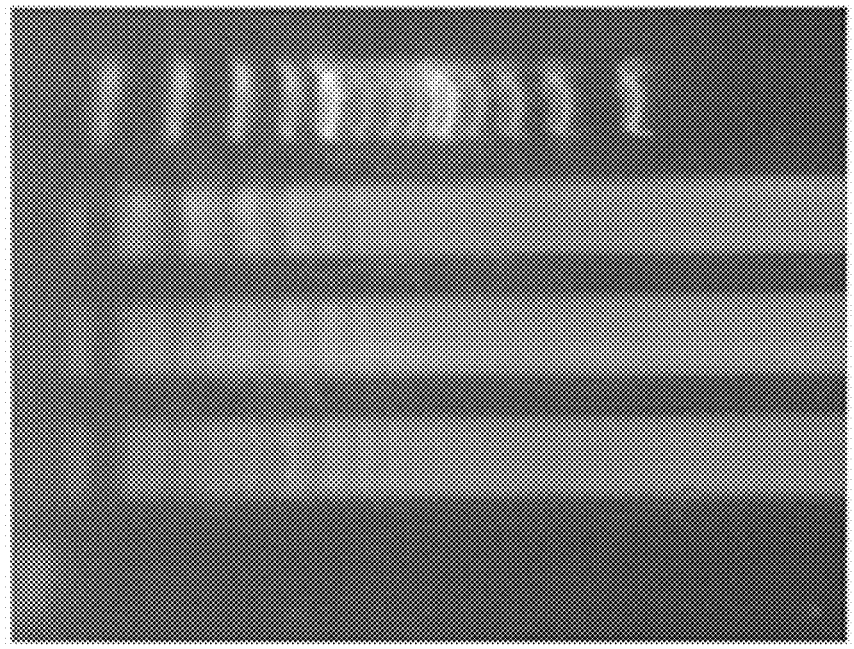
FIG. 44 shows the results of the 1% agarose gel with bands showing the products of the RT-LAMP reaction.

The primers of an RT-LAMP or LAMP reaction were combined for multiplexed amplification. Because of the formation of concatemers during RT-LAMP and LAMP, it is difficult to differentiate between amplicons in a multiplex RT-LAMP or LAMP reaction by conventional means (e.g., by gel electrophoresis), as shown in FIG. 44. Multiplexed RT-LAMP for Influenza A (IAV) and Influenza B (IBV) was carried out for 30 minutes at 60° C. RT-LAMP reactions were incubated with 10,000 viral genome copies of IAV, IBV, or both IAV and IBV. A no-target control (NTC) was used that contained 0 viral genome copies. 0.5 µL of the RT-LAMP product after the 30 minute incubation was run on a 1% agarose gel. FIG. 44 shows the results of the 1% agarose gel with bands showing the products of the RT-LAMP reaction. As seen in the gel, it is difficult to differentiate between the IAV, IBV, and IAV+IBV samples. The application of Type V (e.g. Cas12) enzymes identified which amplicons were amplified in a multiplexed RT-LAMP or LAMP reaction. FIG. 45 shows Cas12a discrimination between amplicons from a multiplex RT-LAMP reaction for Influenza A and Influenza B. FIG. 45A shows a schematic of the workflow including providing viral RNA, multiplexed RT-LAMP amplification, and Cas12a influenza A detection or Cas12a influenza B detection. FIG. 45B shows Cas12a detection of RT-LAMP amplicons after 30 minute multiplexed RT-LAMP amplification at 60° C. Multiplexed amplification contained primer sets for Influenza A (IAV) and Influenza B (IBV). Reactions contained 10000 viral genome copies or 0 copies as a control. Targets for IAV only, IBV only, and IAV and IBV combined were used. FIG. 45C shows background subtracted fluorescence at 30 minutes of Cas12a detection at 37° C. of RT-LAMP amplicons for 10,000 viral genome copies of IAV and IBV. crRNAs specific for IAV and IBV enable discrimination for which viral sample was present. Similarly, FIG. 46 shows Cas12a discrimination between a triple multiplexed RT-LAMP reaction for Influenza A, Influenza B, and the Mammuthus *primigenius* (Wooly Mammoth) mitochondria internal amplification control sequence after 30 minutes of multiplexed RT-LAMP amplification at 60° C. Multiplexed amplification contained primer sets for Influenza A (IAV), Influenza B (IBV), and the Mammoth internal amplification control (Mammoth IAC). Reactions contained 100,000 viral genome copies or 500 aM of the IAC. Targets for IAV only, IBV only, multiplexed IAV+IBV, and multiplexed IAV+IBV+Mammoth IAC were used. Cas12a detection assays at 37° C. with IAV, IBV, and Mammoth IAC specific crRNAs were performed to differentiate the amplicons from the multiplexed reactions.

Figure 47A:
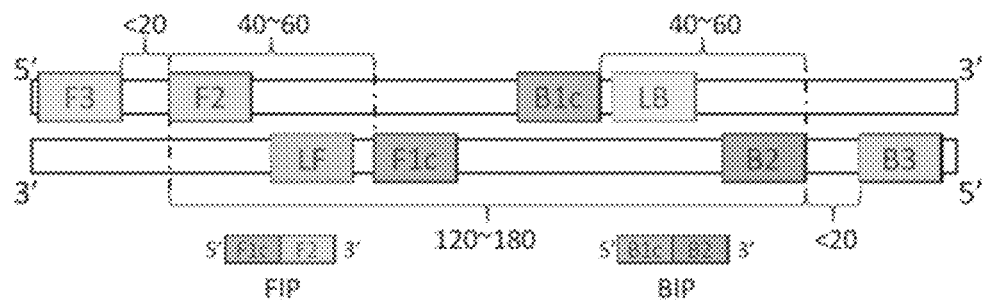
FIG. 47A shows a schematic illustrating the identity of the primers used in LAMP and RT-LAMP. Primers LF and LB are option in some LAMP and RT-LAMP designs, but generally increase the efficiency of the reaction.
Figure 47B:
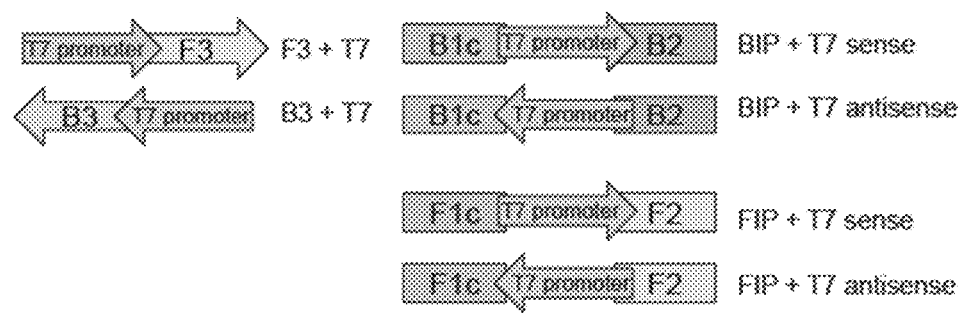
FIG. 47B shows a schematic illustrating the position and orientation of the T7 promoter in a variety of LAMP primers.

By including a T7 promoter sequence in the forward inner primers (FIP) or backward inner primers (BIP) of a LAMP or RT-LAMP reaction, the resulting amplicon can be added to an in vitro transcription reaction to generate RNA, as shown in the schematic in FIG. 47. This RNA can be used in a Type VI (e.g. Cas13) detection assay. FIG. 47A shows a schematic illustrating the identity of the primers used in LAMP and RT-LAMP. Primers LF and LB are option in some LAMP and RT-LAMP designs, but generally increase the efficiency of the reaction. FIG. 47B shows a schematic illustrating the position and orientation of the T7 promoter in a variety of LAMP primers.

FIG. 48 shows that a T7 promoter can be included on the F3 or B3 primers (outer primers), or FIP or BIP primers for Influenza A. However, only T7 promoters located in the FIP or BIP primers are capable of generating enough RNA to enable a Cas13a detection assay. FIG. 48A shows a schematic of the workflow including providing DNA/RNA, LAMP/RT-LAMP amplification, in vitro transcription, and Cas13a detection. FIG. 48B shows the time to result for RT-LAMP reactions for Influenza A using different primer sets, as quantified by fluorescence. Each primer set contained a T7 promoter sequence in a different position. Time to result was determined by the time to reach half of max fluorescence for a reaction. No target was used as a specificity control. The results demonstrated that the B3+T7 and BIP+T7 sense primer sets worked best for RT-LAMP reaction. The reaction was performed at 68° C. for 30 minutes. FIG. 48C shows in vitro transcription (IVT) with T7 RNA polymerase of the product of the RT-LAMP reactions for Influenza A using different primer sets at 37° C. for 10 minutes. A Cas13a detection assay at 37° C. was then used to detect the RNA products from the IVT reaction. Three different on-target crRNAs were used along with an off-target crRNA to demonstrate specificity. The BIP+T7 sense and antisense primer sets worked best for RNA production, along with on-target crRNA #2. Thus, the BIP+T7 sense primer set in conjunction with crRNA #2 worked best for the detection of RNA after a RT-LAMP reaction followed by an IVT reaction.

Figure 49:
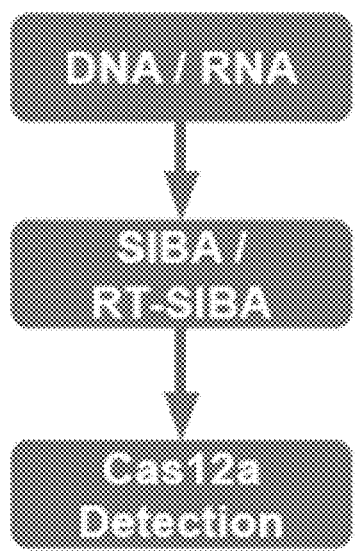
FIG. 49 shows the detection of a RT-SIBA amplicon for Influenza A by Cas12. At left is a schematic of the workflow including providing DNA/RNA, SIBA/RT-SIBA, and Cas12a detection. At right is a graph showing Cas12a detection as measured by fluorescence for each of the tested conditions.
Figure 49:
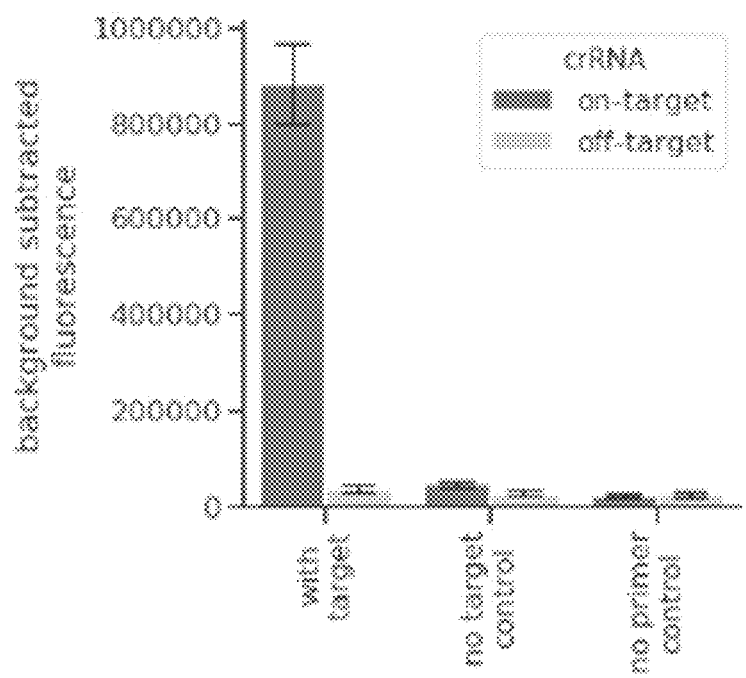

SIBA. Strand invasion based amplification (SIBA) is another isothermal method that can be used. FIG. 49 shows the detection of a RT-SIBA amplicon for Influenza A by Cas12. In SIBA and RT-SIBA reactions for Cas12, the guide RNA is not complementary to the invasion oligo and the amplicon contains a PAM. The RT-SIBA reaction was performed at 41° C. for 60 minutes with a starting RNA concentration of 500 aM. Controls for the RT-SIBA reaction included a no target control and a no primer control. After the completion of the RT-SIBA reaction, 2 µL of amplicon was added to a 20 µL Cas12a detection reaction. On-target and off-target crRNAs were used to show specific detection of by Cas12.

Example 35

Optimization of Assay Conditions for Programmable Nuclease-Based Diagnostic Assays This example describes optimization of assay conditions for programmable nuclease diagnostic assays as disclosed herein. Here, the CRISPR-Cas DETECTR-based diagnostic assays disclosed herein were used as the programmable nuclease diagnostic assays. The components of the DETECTR reaction, such as protein concentration, crRNA, and buffer components impact the rate and efficiency of the reaction. Optimization of the buffers allows for the development of an assay with increased sensitivity and specificity.

Improvements to buffers and assay conditions were identified for Cas13M26 (Lbu-Cas13a) included 100 ng/4 of tRNA. The performance of the original buffer for Cas13a detection (including the 100 ng/µl of tRNA) is shown on the graph is the middle-most line. Cas13a was incubated with 1 pM of target RNA at 37° C. with varying concentrations of tRNA in the reaction buffer. As a control, the assay was also performed with 0 pM of the target RNA. FIG. 50 shows graphs of activity, as measured by fluorescence, with (left graph) and without (right graph) activator over time. FIG. 50 shows that increasing the amount of tRNA in the reaction decreases the efficiency of the Cas13a detection assay. Similarly, decreasing the amount of tRNA in the reaction or eliminating it completely, increases the efficiency of the Cas13a detection assay without dramatically changing the stability of the reaction in the absence of activator.

Urea is an additive that is used to increase the efficiency of some enzymatic reactions, such as proteinase K digestion, and is present in urine. To evaluate inhibition of Cas13a activity in the DETECTR assays, 1 pM of target RNA at 37° C. was incubated with varying concentrations of urea. The activator, shown in the following graphs, is the target RNA. FIG. 51 shows inhibition of Cas13a activity by SDS and urea. FIG. 51A shows the Cas13a detection assay performed in the presence of 0-200 mM urea. Concentrations above 300 mM urea inhibited the assay (left graph shows with activator and right graph shows without activator). The orange line indicates the performance of the assay with 0 mM urea (a control showing uninhibited Cas13a activity). SDS is a common inhibitor of RNases and is used to eliminate RNase contamination and denature proteins. To evaluate inhibition of Cas13a activity in DETECTR assays, 1 pM target RNA at 37 C was incubated with varying amounts of SDS. FIG. 51B shows complete inhibition of Cas13a upon addition of 0.1% or greater amounts of SDS to the reaction (left graph shows with activator and right graph shows without activator). The orange line indicates performance of Cas13a with 0% SDS (a control showing uninhibited Cas13a activity).

Figure 52:
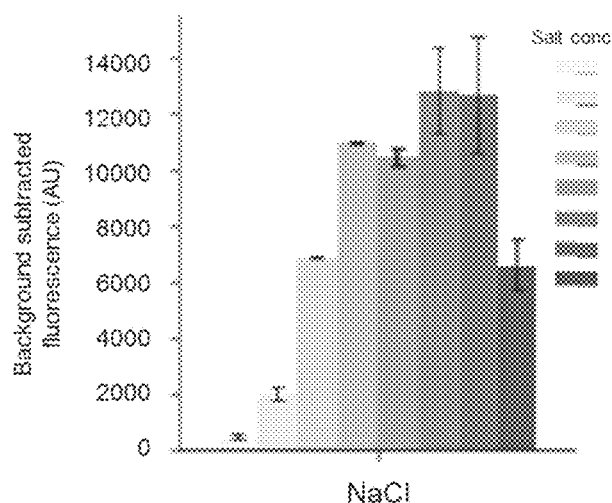
FIG. 52 shows the performance of Cas13a in DETECTR reactions with varying concentrations of salt.
Figure 52:
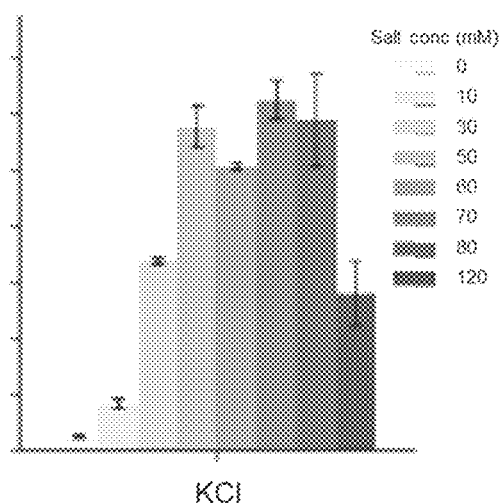

The importance of salt type and salt concentration on the performance of Cas13a in a DETECTR assay was evaluated. DETECTR assays were performed with 10 pM of target or 0 pM of target (control). FIG. 52 shows the performance of Cas13a in DETECTR reactions with varying concentrations of salt. FIG. 52A shows the results of varying the concentration of NaCl in a Cas13a DETECTR reaction. FIG. 52B shows the results of varying the concentration of KCl in a Cas13a DETECTR reaction. Cas13a performed comparably between NaCl and KCl salt types. Cas13a performance decreased at 30 mM salt and below, and was inhibited by salt concentrations above 80 mM.

Figure 53:
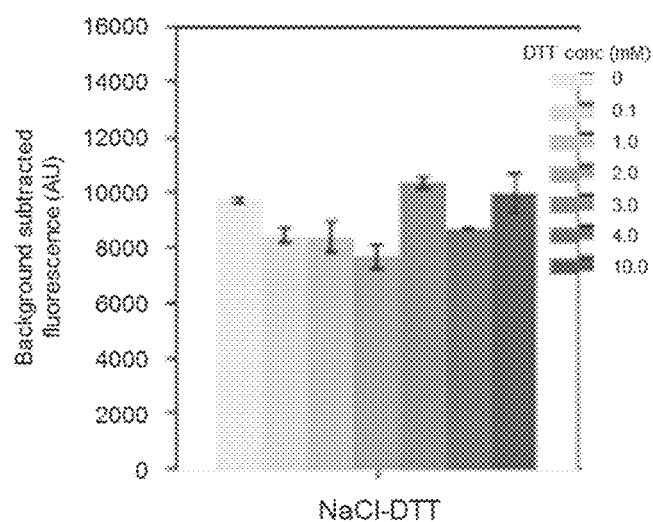
FIG. 53 shows optimization of DTT concentration in a Cas13a DETECTR assay.
Figure 53:
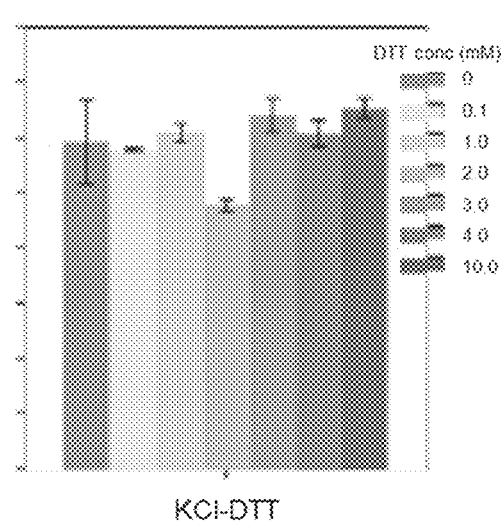

The importance of DTT in different salt types and its impact on Cas13a performance in a DETECTR assay was evaluated. DTT is used to stabilize proteins, such as RNase inhibitors, and increase the efficiency of some enzymes. DETECTR assays were carried out using Cas13a for detection of 10 pM of target or no target (control). FIG. 53 shows optimization of DTT concentration in a Cas13a DETECTR assay. FIG. 53A shows varying DTT concentration in NaCl. FIG. 53B shows varying DTT concentrations in KCl. The orange bar indicates original buffer conditions (50 mM KCl) and no DTT. The results showed that the Cas13a DETECTR assay was not affected by DTT concentrations from 0-10 mM in buffers containing either NaCl or KCl.

Reporter choice for the Cas13a DETECTR assay was evaluated. The quenched fluorescent reporter generates the fluorescent signal that is used to monitor Cas13a detection performance in the DETECTR assays. A variety of different RNA reporter sequences was evaluated for their impact on assay performance. Cas13a detection assays were performed with either 1 pM target RNA or no target RNA at 37° C. Reactions were performed in either the standard Cas13a reaction buffer (HEPES pH 6.8 buffer with tRNA; 20 mM HEPES, pH 6.8; 50 mM KCl; 5 mM MgCl2; 10 µg/mL BSA; 100 µg/mL tRNA; 0.01% Igepal Ca-630; 5% glycerol) or in an identical buffer that lacked background tRNA "RNAlessPB". FIG. 54 shows the activity of Cas13a in the DETECTR assay, as measured by fluorescence, for each of the tested reporters. The "U5" reporter (/5-6FAM/rUrUrU-rUrU (SEQ ID NO: 1)/3IABkFQ/) and the "UU" reporter (/56-FAM/TArUrUGC/3IABkFQ/) exhibited the best performance. A reporter with the same nucleotide sequence as the "U5" reporter but with a different fluorophore and quencher, "TYE665U5" (/5-TYE665/rUrUrUrUrU (SEQ ID NO: 1)/3IABkRQ/) also performed well. Increasing the length of the reporter generated higher background in processing buffers that did not contain background RNA.

The optimal buffer composition and pH for Cas13a DETECTR assays was identified. To determine the ideal buffer and pH for the Cas13a detection assay, 84 different combinations of buffers and pH were tested. The final buffer concentration used in each assay was 20 mM. Aside from the buffer itself, the remaining assay components included 50 mM KCl, 5 mM MgCl2, 10 µg/mL BSA, 100 µg/ML tRNA, 0.01% Igepal Ca-630, and 5% Glycerol. Cas13a DETECTR assays were performed with 1 pM target RNA or no target RNA as a control. The dotted line indicates performance of the standard Cas13a reaction buffer (also referred to as "HEPES pH 6.8 buffer"; HEPES pH 6.8 buffer with tRNA; 20 mM HEPES, pH 6.8; 50 mM KCl; 5 mM MgCl2; 10 µg/mL BSA; 100 µg/mL tRNA; 0.01% Igepal Ca-630; 5% glycerol). Dots indicate replicates. FIG. 55 shows Cas13a activity in the DETECTR assay, as measured by fluorescence, for each of the tested conditions. These results demonstrated that the optimal pH is around 7.5 and that the imidazole, phosphate, tricine, and SPG buffers are all high performing buffers, in comparison to the original HEPES pH 6.8 buffer. Cas13a detection was inhibited at pH values below 6.5. Dots indicate replicates, while bar height indicates the mean of the replicates.

Cas13a activity in DETECTR assays was assessed in a variety of commercially available buffers. Cas13a detection assays were carried out with either 1 pM target RNA or no target RNA at 37° C. Reactions were performed either in the presence or absence of 100 ng/µL tRNA. Buffers used included NEB1 (NEBuffer1, New England Biolabs (NEB)), NEB2 (NEBuffer2, NEB), NEB3 (NEBuffer3, NEB), Cut-smart (NEB), RNPB (RNA polymerase buffer, NEB), and the HEPES pH 6.8 buffer. These buffer compositions are as follows: NEBuffer 1.1 (1× Buffer Components, 10 mM Bis-Tris-Propane-HCl, 10 mM MgCl2, 100 µg/ml BSA, pH 7.0 at 25° C.); NEBuffer 2.1 (1× Buffer Components, 50 mM NaCl, 10 mM Tris-HCl, 10 mM MgCl2, 100 µg/ml BSA, pH 7.9 at 25° C.); NEBuffer 3.1 (1× Buffer Components, 100 mM NaCl, 50 mM Tris-HCl, 10 mM MgCl2, 100 µg/ml BSA, pH 7.9 at 25° C.); CutSmart Buffer (1× Buffer Components, 50 mM Potassium Acetate, 20 mM Tris-acetate, 10 mM Magnesium Acetate, 100 µg/ml BSA, pH 7.9 at 25° C.); and 1× RNAPol Reaction Buffer (40 mM Tris-HCl, 6 mM MgCl2, 1 mM DTT, 2 mM spermidine (pH 7.9 at 25° C.)). The results demonstrated that Cas13a performance improved in NEBuffer2 and Cutsmart in comparison to the HEPES pH 6.8 buffer. FIG. 56 shows Cas13a performance in the DETECTR assay, as measured by fluorescence, for each of the five commercially available buffers and the original HEPES pH 6.8 buffer.

Combining the above described observations of buffer performance, an optimized Cas13a buffer called MBuffer1 was developed. 1× MBuffer1 includes 20 mM imidazole pH 7.5, 50 mM KCl, 5 mM MgCl2, 10 µg/µL BSA, 0.01% Igepal Ca-630, and 5% glycerol. FIG. 57 shows a head-to-head comparison of the HEPES pH 6.8 buffer to the optimized MBuffer1 for a Cas13a DETECTR assay with serially diluted target RNAs and run at 37° C. for 30 minutes. The limit of detection for the HEPES pH 6.8 buffer was around 1 pM, whereas the limit of detection for MBuffer1 was found to be between 100 fM and 10 fM. Thus, FIG. 57 demonstrates that there is a 10× and 100× improvement in assay performance using MBuffer1.

Figure 58:
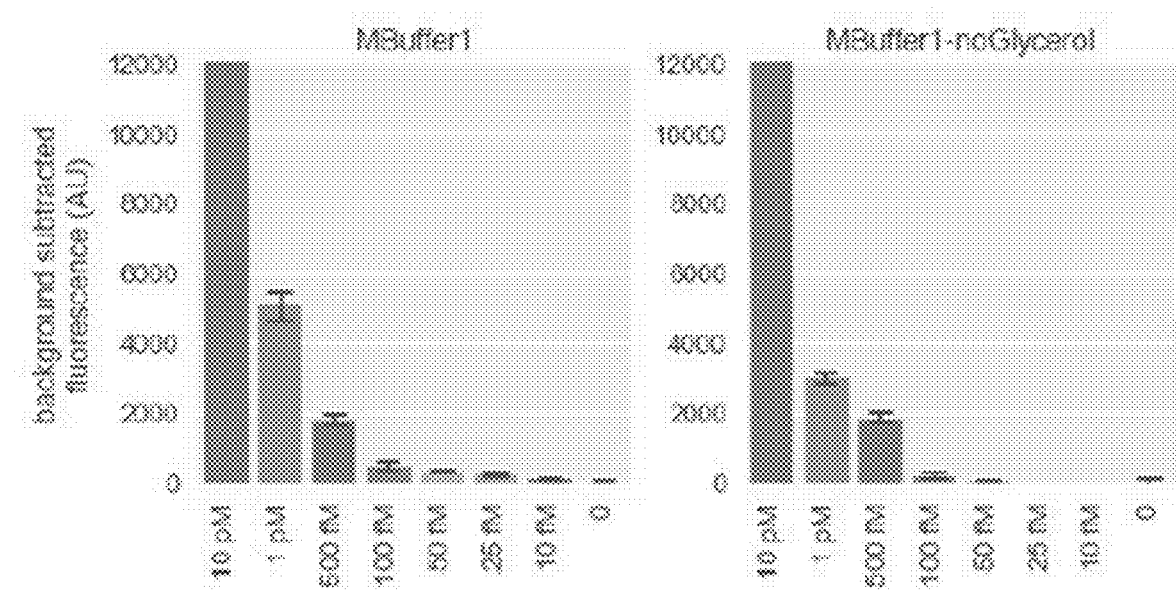
FIG. 58 shows that 5% glycerol in MBuffer1 (left graph) increases assay performance in comparison to an identical buffer without glycerol (right graph).

Cas13a performance in DETECTR assays was evaluated with and without glycerol. Glycerol is commonly used in many enzymatic buffers. Cas13a detection assays with varying concentrations of target RNA were run at 37° C. for 30 minutes in either MBuffer1 with glycerol or MBuffer1 without glycerol. FIG. 58 shows that 5% glycerol in MBuffer1 (left graph) increases assay performance in comparison to an identical buffer without glycerol (right graph).

Figure 59:
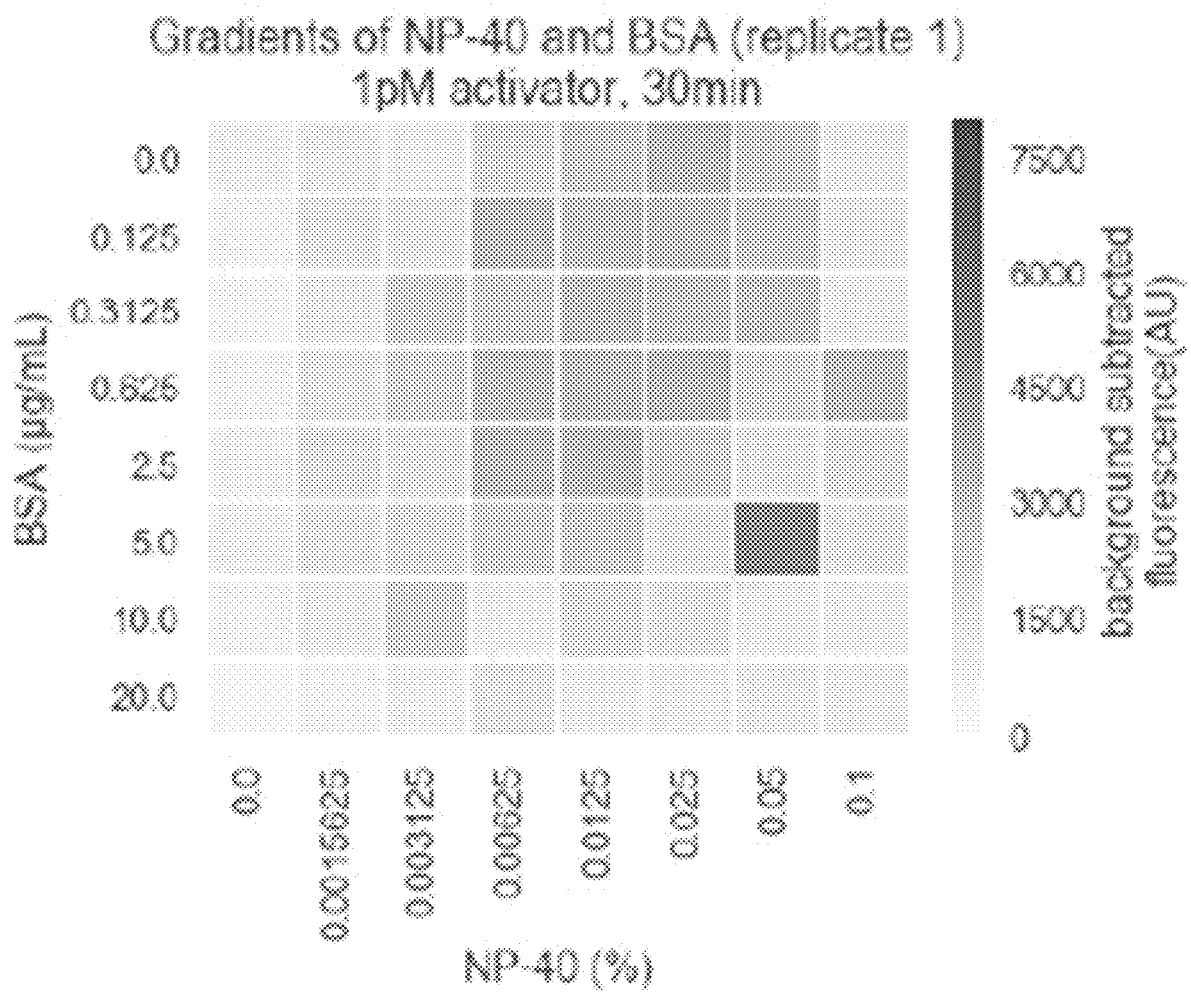
FIG. 59 shows a gradient chart of Cas13a activity in the DETECTR assay, as measured by fluorescence, (darker squares indicate increased Cas13a activity) versus varying NP-40 concentration along the x-axis and varying BSA concentration along the y-axis.

Cas13a performance in DETECTR assays was evaluated with varying concentrations of BSA and NP-40. BSA and NP-40 (Igecal-Ca 630) are used in many enzymatic buffers to increase assay performance and decrease binding of the protein to plastic surfaces. Cas13a DETECTR assays were run with 1 pM target RNA or no target RNA at 37° C. for 30 minutes in MBuffer1 with varying concentrations and combinations of NP-40 (Igepal Ca-630) and BSA. FIG. 59 shows a gradient chart of Cas13a activity in the DETECTR assay, as measured by fluorescence, (darker squares indicate increased Cas13a activity) versus varying NP-40 concentration along the x-axis and varying BSA concentration along the y-axis. The results indicated that both BSA and NP-40 improve the assay. NP-40 (Igecal-Ca 630) was found to be important for the efficiency of the Cas13a detection assay. Small amounts of BSA also improved the performance of the assay. Concentrations of 0.05% to 0.0625% NP-40 were most optimal and concentrations of 2.5 to 0.625 µg/mL BSA were most optimal. BSA did not improve assay performance unless NP-40 was also present.

To determine which types of compounds may increase or inhibit the performance of Cas13a in DETECTR assays, assays were run with 96 different additives (JBScreen Plus HTS, Jena Biosciences). Additives from the Jena Biosciences plate were diluted 1:66 into the final Cas13a DETECTR assay with 100 pM of target. FIG. 60 shows Cas13a performance in DETECTR assays, as measured by fluorescence, versus the different additives tested. Results showed that the specific compounds that inhibited the performance of the assay included: beryllium sulfate, manganese chloride, zinc chloride, tri-sodium citrate, copper chloride, yttrium chloride, 1-6-Diaminohexane, 1-8-diaminooctane, ammonium fluoride, ethanolamine, lithium salicylate, magnesium sulfate, potassium cyanate, and sodium fluoride.

The original buffer developed for Lba-Cas12a used Tris pH 7.5. FIG. 61 shows the results of screening 84 different buffer and pH combinations to determine the optimal buffer for Lba-Cas12a activity in DETECTR assays, as measured by fluorescence. A final buffer concentration of 20 mM was used for each assay. The remaining assay components included 100 mM KCl, 5 mM MgCl2, 50 µg/mL heparin, 1 mM DTT, and 5% Glycerol. Lba-Cas12a DETECTR assays were performed at 37° C. with 100 pM target DNA or no target DNA as a control. The dotted line indicates performance of the original buffer. Dots indicate replicates, while the bar height indicates the mean of the replicates. Results of this experiment showed that Lba-Cas12a prefers pH 8.0 and works well in AMPD, BIS-TRISpropane, DIPSO, HEPES, MOPS, TAPS, TRIS, and tricine buffers. Lba-Cas12a was inhibited at pH 6.5 and below and was not functional in phosphate, succinate, malonate, citrate, MES, and ADA buffers.

The optimal salt type and salt concentration was determined for Lba-Cas12a performance in DETECTR assays. Lba-Cas12a DETECTR assays were run with 10 pM of target DNA or no target DNA at 37° C. for 30 minutes with varying concentrations of KCl. FIG. 62 shows Lba-Cas12a performance in DETECTR assays, as measured by fluorescence, in each of the tested conditions. Results indicated that the Lba-Cas12a performed best in assays with low KCl concentrations (0-40 mM or less than 20 mM salt and less KCl). Above 80 mM the assay was inhibited, with little to no activity above 160 mM.

The optimal buffer type and pH was determined for the Type V CRISPR-Cas protein Cas12M08 performance in DETECTR assays. FIG. 63 shows Cas12M08 performance in DETECTR assays, as measured by fluorescence, for each of the tested conditions (buffer type and pH). The final concentration of buffer in each assay was 20 mM. The remaining assay components included 120 mM NaCl, 5 mM MgCl2, and 1% Glycerol. Cas12M08 DETECTR assays were performed at 37° C. with 1 nM target DNA or no target DNA as a control. The dotted line indicates the performance of the buffer used in Cas12M08 DETECTR assays (20 mM Tris-HCl, pH 7.5; 120 mM NaCl; 5 mM MgCl2; 1% glycerol). Results showed that Cas12M08 performed optimally in a pH of 7.5. High performance buffers included DIPSO, HEPES, MOPS, TAPS, imidazole, and tricine. Cas12M08 was inhibited in Tris buffers, but was still functional. Cas12M08 showed little or no functional activity in succinate, malonate, MES, ADA, citrate, SPG, and phosphate buffers.

Further investigation of the optimal buffer type and pH was carried out for Cas12M08. Some proteins prefer buffers that have reduced numbers of chloride ions. To determine whether Cas12M08 performed better in chloride—("Cl") or acetate-based ("Acetate") buffers, a screen of salt type and concentration was carried out. FIG. 64 shows Cas12M08 performance in DETECTR assays, as measured by fluorescence, for the various salt types and concentrations tested. Assay components included 20 mM HEPES pH 7.3, 1% Glycerol, and 5 mM of MgCl or MgOAc. Varying amounts of KCl or KOAc were screened with the corresponding magnesium type. Cas12M08 detection assays ere carried out at 37° C. with 1 nM target DNA and no target DNA as a control for 30 minutes. Cas12M08 performed best at a salt concentration of around 4 mM (ranging from 2-10 nM) and showed increased activity in buffers with MgOAc and KOAc (acetate-based buffers, "Acetate"), in comparison to buffers with MgCl and KCl (chloride-based buffers, "Cl").

Figure 65:
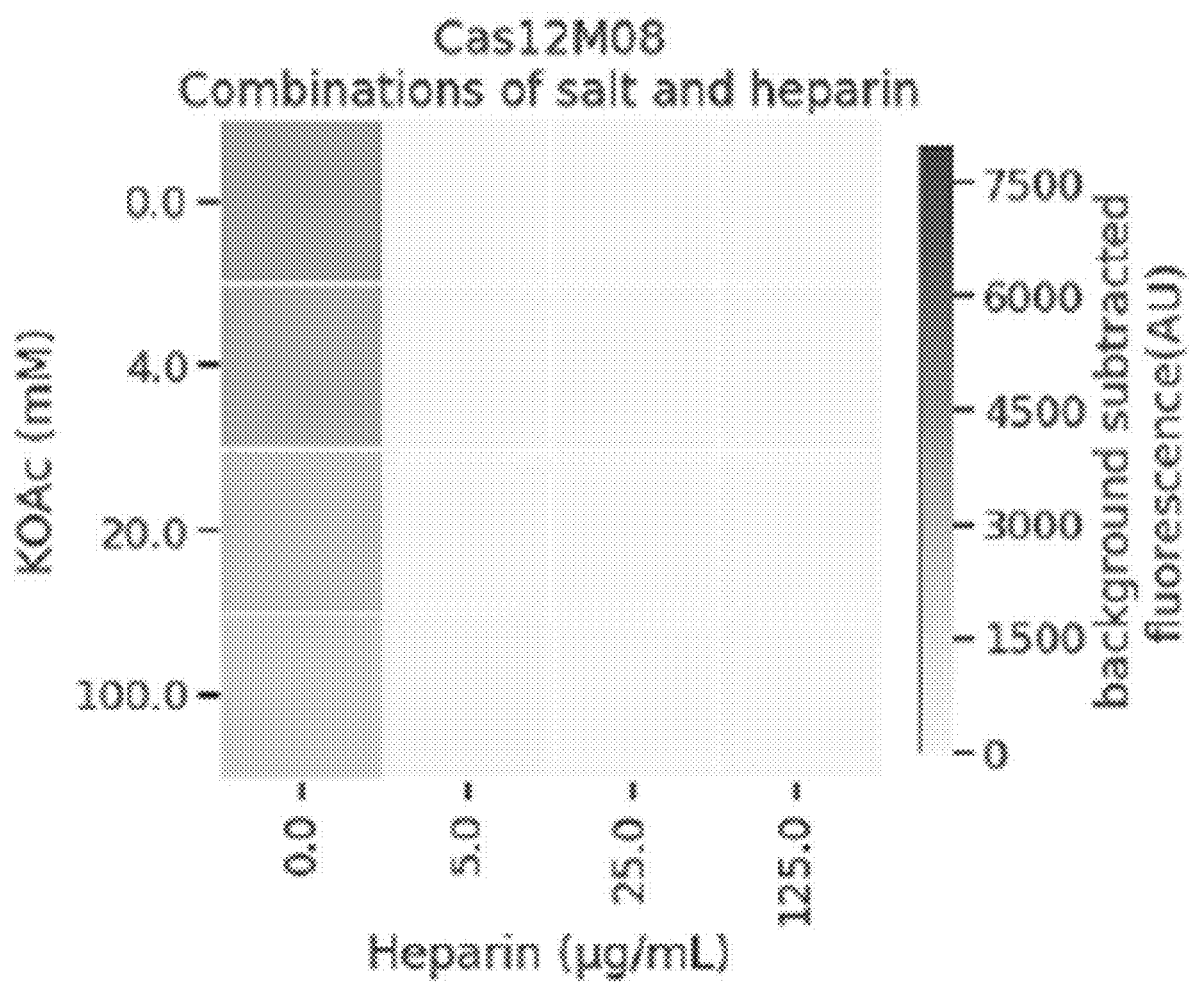
FIG. 65 shows Cas12M08 performance in DETECTR assays, as measured by fluorescence (darker squares indicate greater fluorescence and more activity), versus heparin concentration on the x-axis and KOAc buffer concentration on the y-axis.

The optimal concentrations of heparin and salt concentrations were determined for Cas12M08, since a relationship was observed between salt and heparin for SNP sensitivity using Lba-Cas12a. The base buffer included 20 mM HEPES pH 7.3, 5 mM MgOAc, and 1% Glycerol. Varying amounts of KOAc and heparin were screened. Cas12M08 DETECTR assays were performed at 37° C. with 1 nM target DNA or no target DNA as a control for 30 minutes. For Lba-Cas12a heparin and salt concentrations combined to affect the specificity of the enzyme. FIG. 65 shows Cas12M08 performance in DETECTR assays, as measured by fluorescence (darker squares indicate greater fluorescence and more activity), versus heparin concentration on the x-axis and KOAc buffer concentration on the y-axis. The results of this experiment indicated that Cas12M08 was inhibited by heparin and prefers low salt.

Inhibitors and enhancers of assay performance were evaluated for Cas12M08 DETECTR assays. DETECTR assays were run with 96 different additives (JBScreen Plus HTS, Jena Biosciences). Additives from the Jena Biosciences plate were diluted 1:66 into a final Cas12M08 detections assay with 1 nM of target. FIG. 66 shows that specific compounds inhibited the performance of the assay including: benzamidine hydrochloride, beryllium sulfate, manganese chloride, potassium bromide, sodium iodine, zinc chloride, di-ammonium hydrogen phosphate, tri-lithium citrate, tri-sodium citrate, cadmium chloride, copper chloride, yttrium chloride, 1-6 diaminohexane, 1-8-diaminooctane, ammonium fluoride, and ammonium sulfate. Compounds that increased assay performance included: polyvinyl alcohol type II, DTT, DMSO, polyvinylpyrrolidone K15, polyethylene glycol (PEG) 600, and polypropylene glycol 400.

Figure 67:
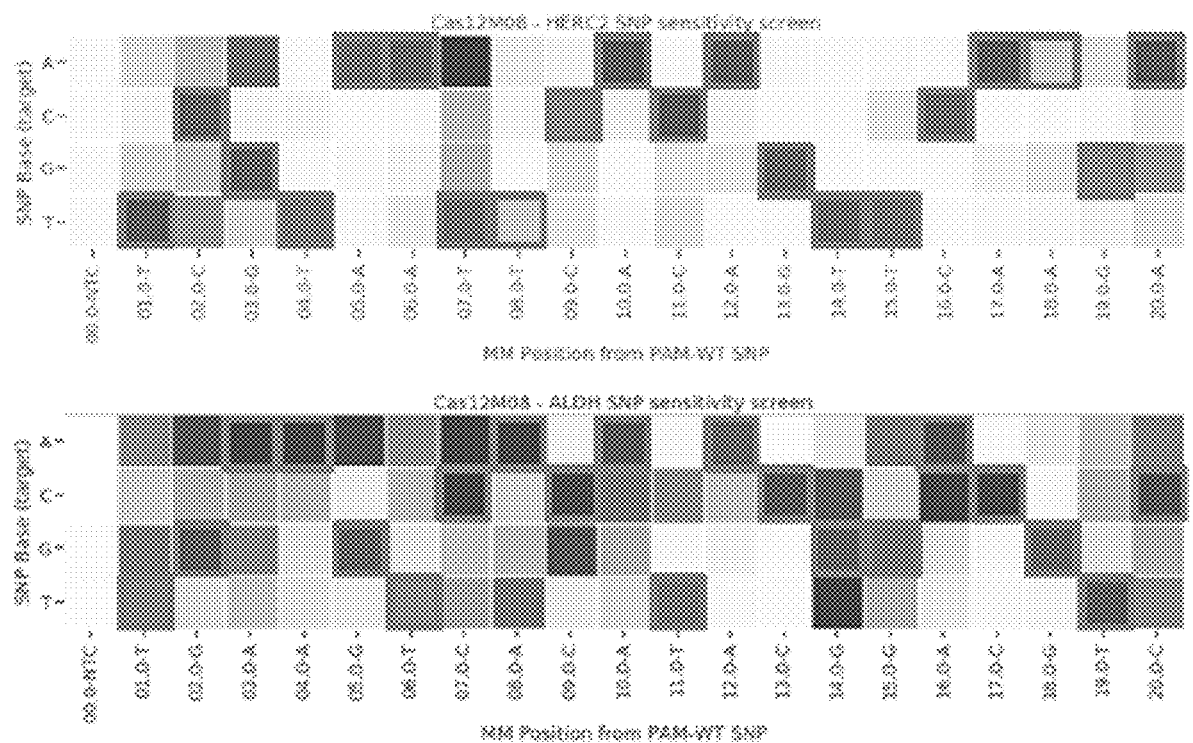
FIG. 67 shows the results of evaluating SNP sensitivity along target sequences for Cas12M08.
Figure 68:
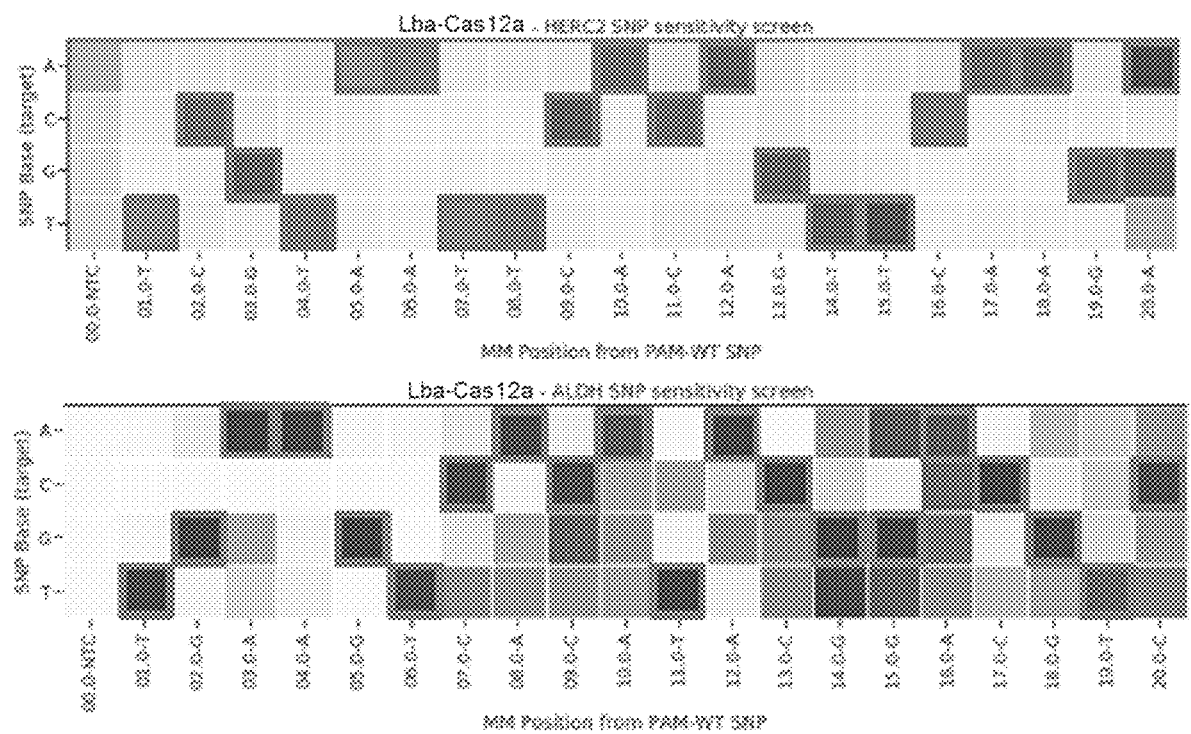

The positions along a target sequence most sensitive to single mutations was identified by tiling all nucleotide possibility (A, T, C, G) at the 20 positions downstream of the PAM motif along a Cas12M08 target site on HERC2 and ALDH. FIG. 67 shows the results of evaluating SNP sensitivity along target sequences for Cas12M08. Squares with a bolded outline indicate the WT sequence that matched the crRNA was used to interrogate the sensitivity of Cas to mutations along a target site on HERC2 and ALDH. Results indicated stronger SNP differentiation for Cas12M08 along the 3' end of the crRNA (distal from the PAM). A similar complementary experiment using Lba-Cas12a using the same sets of target sites and crRNAs was carried out. FIG. 68 shows the results of evaluating SNP sensitivity along target sequences for Lba-Cas12a. Lba-Cas12a displayed strong mutation sensitivity at all positions along HERC2, and sensitivity on the PAM proximal (complementary to the 5' end of the crRNA target sequence) on ALDH2. This suggested that Lba-Cas12a was more sensitive to mutations in this region and that mutation sensitivity as target site dependent.

Example 36

Lateral Flow Test Strips for Visual Detection of Target Nucleic Acids Using a Programmable Nuclease System This example describes a lateral flow test-strip for visual detection of reactions using a programmable nuclease system. Here, the DETECTR reactions using CRISPR-Cas systems were used as the reactions using the programmable nuclease systems.

Visual readouts for the DETECTR reaction were developed to have a low-cost format and be amenable to high-volume manufacturing. Described here are custom-made lateral flow strips. Colloidal gold nanoparticles were conjugated to antibodies and the gold nanoparticles served as the visual readout in the assay. Two commercially available lateral flow strips were also tested including: (1) Millenia Hybridetect 1, TwistDx (UK, now part of Abbott) and (2) PCRD, Abingdon Health (UK).

Results were collected by: (1) visual inspection of the strips, and (2) obtaining a cell-phone-camera picture of the strips.

Unlike commercially available lateral flow test strips, the custom-made lateral flow strip design disclosed herein includes a new type of CRISPR-Cas reporter molecule, which is made of (1) a 6-Fluorescein (FAM) moiety; (2) a biotin moiety; and (3) a DNA-based oligo linker, which will be irreversibly conjugated to the DETECTR reaction chamber upstream of the reaction.

Lateral Flow Strips for Read Out of Cas12M08 and Lba-Cas12a. Lateral flow strips were tested for readout of Cas12M08 and Lba-Cas12a. Complexing reactions included final concentrations of 40 nM of crRNA per reaction, 40 nM of final protein per reaction, and 500 nM of reporter per reaction. Complexing reactions were incubated at 37 C for 30 min, the reporter substrate was added, and 15 μl of the complexing reactions were aliquoted into PCR tubes. 5 μl of diluted PPR virus PCR product was added and the target and complex were incubated at 37 C for 20 min. 100 μl of Milenia GenLine Dipstick Assay Buffer (Tween or Triton) was added and the dipstick was inserted into the solution with target and complex. Test strips were photographed and the top band was quantified using ImageJ.

FIG. 69A shows a photograph of test strips, which from left to right show Lba-Cas12a with target, Lba-Cas12a without target, Cas12M08 with target, and Cas12M08 without target.

FIG. 69B shows a graph of absorbance on the y-axis for each group tested (Lba-Cas12a with target, Lba-Cas12a without target, Cas12M08 with target, and Cas12M08 without target). The y-axis shows absorbance as quantified by ImageJ.

MNT-Lateral Flow, Au NP Conjugation. Anti-FAM and anti-ROX polyclonal antibodies were conjugated to gold nanoparticles for downstream use in the custom made lateral flow strips. Materials include Corning Spin-X UF 500 μl Concentrators and a Gold in a Box Conjugation kit. A 0.5× buffer solution was prepared by diluting PBS, pH 7.2 (1×) in 1:1 with nuclease-free water. 100 μl of the MNT antibody and 100 μl of a FITC antibody were used. Spin concentrators were used to exchange native buffer from 0.1M Tris glycerine, pH 7 with 10% glycerol to 0.5×PBS for both antibodies. Washes with 100 μl of 0.5×PBS was carried out and the concentrators were spun for 1.5 min at 18,000 rcg (xg) for each wash. Antibodies were eluted in 100 μl of 0.5×PBS. Gold conjugation was carried out as per manufacturer's instructions. Tubes were labeled MNT1-10 and FITC1-10 and 7 μl of each antibody was added. Reactions were incubated for 30 min in a shaking incubator at room temperature. The reaction was stopped by adding 50 μl of a BSA blocking buffer to each tubes, and tubes were stored at 4 C.

Lateral Flow Strips for Read Out of Cas13M. Lateral flow strips were tested for readout of Cas13M. TwistDx lateral flow strips were used to test the FAM-US-Biotin (rep71 reporter). Assays were run at room temperature at a variety of target concentrations. Complexing reactions included final concentrations of 40 nM of crRNA per reaction, 40 nM of final protein per reaction, and 500 nM of reporter per reaction. Complexing reactions were incubated at 37 C for 30 min. Dilutions of the target were added to the reaction including at 10 nM, 1 nM, 0.1 nM, 0.01 nM, and no target. 30 µl of the complexing reaction was added to the target and incubated for 15 minutes at room temperature. The reaction was placed on ice and 10 µl of the reaction was pipetted directly onto the lateral flow sample area. 50 µl of Milenia GenLine Dipstick Assay buffer was added and the strip was photographed.

FIG. 69C shows a photograph of various test strips from Cas13M DETECTR assays with, from left to right, 10 nM, 1 nM, 0.1 nM, 0.01 nM, target DNA, no target DNA, or water only.

Conjugation of 3' Amino Reporter to NHS Beads Using Kit. An NHS FlexiBind Magnetic Bead Kit was used to conjugate the 3' amino modified lateral flow reporter that allowed for the intended usage of the lateral flow devices (Milenia Hybrid), where the ligand is detected first and the control line serves as the flow control. The sequence of the reporter used was /56-FAM/*/iBiodT/*AATTAATTAAT-TAATTAATT/3AmMO/ (SEQ ID NO: 170).

Bead Conjugation was carried out as follows. Rep75 was resuspended to 100 µM in Wash/Coupling Buffer (PBS, pH 7.4). 32.5 nmol was delivered from IDT and 5.4 nmol (54 µL) of rep75 was used. Resuspend of the 20% NHS Flexi-Bind Magnetic beads was resuspended by vortexing for 20 seconds. 100 µL of bead slurry was pipetted into a 1.5 mL microcentrifuge tube. Magnetic beads were pelleted on the magnetic stand until the solution became clear. Storage buffer was removed and discarded. 100 µL of ice-cold Equilibration buffer (1 mM HCl) was immediately added. The reaction was removed from the magnet and vortexed for 20 seconds then placed back on the magnet to pellet beads. The supernatant was removed and discarded and 544 of 100 µM rep75 in PBS was added. Beads were incubated at room temperature with interval mixing: 2 min rest, 15 sec mix at 1200 rpm for 2 hours. Tubes were placed in a magnetic stand to allow the beads to migrate to the magnet. Unbound ligand was removed and saved for analysis.

0.5 µL raw reporter was measured in 204 NFW vs. 0.54 post-conjugation supernatant in 204 NFW on a plate reader until it was no longer visibly green. 500 µL of Quench buffer was added, vortexed for 30 seconds, and pelleted with a magnetic rack. The supernatant was discarded and the sample was washed 5 times. Beads were resuspended in 500 µL of Quench Buffer and incubated for 1 hour at room temperature. The beads were pelleted with a magnetic rack and the buffer was removed and discarded. The beads were resuspended in 100 µL of Wash/Coupling Buffer (PBS, pH 7.4) and the beads were kept on ice in dark tube.

Testing uncleaved/unconjugated reporter with lateral flow was carried out using 2× NG-40-B009 Naked Gold Sol beads—40 nm—15 OD—9 mL, FITC antibody (Invitrogen TB265150), anti-IgG (Invitrogen A16098), Streptavadin (NEB N7021S), pH 8.8, and three batches—Batch 1: AU (5 µL)→anti-IgG (1 µL)→Strep (0.5 µL), Batch 2: AU (5 µl)→strep (1 µL)→anti-IgG (1 µL), and Batch 3: AU (2.5 µL)→strep (1 µL)→anti-IgG (1 µL).

Test beads with Cas12M08 by first complexing reaction. Reactions were run with final concentrations of 40 nM crRNA per reaction, 40 nM protein per reaction, and 100, 250, 500, or 1000 nM reporter per reaction. The complex was incubated at 37° C. for 30 min. The 40 µM stock of beads was diluted to 1:10 to 4 µM. Reporter beads were added to 5 µL PPRV diluted PCR product or NFW, 15 µL of complexing reaction was added to target. The reaction was incubated at 37 C for 30 min with shaking at 2000 rpm in Thermomixer. Beads were pelleted with magnetic rack for 2 minutes. 10 µL of reaction was transferred to a new tube, 50 µL of Dipstick Assay Buffer was added, and 60 µLdiluted reaction was placed on magnet before adding solution to lateral flow strips. Reactions were run on Milenia flow strips.

Figure 70:
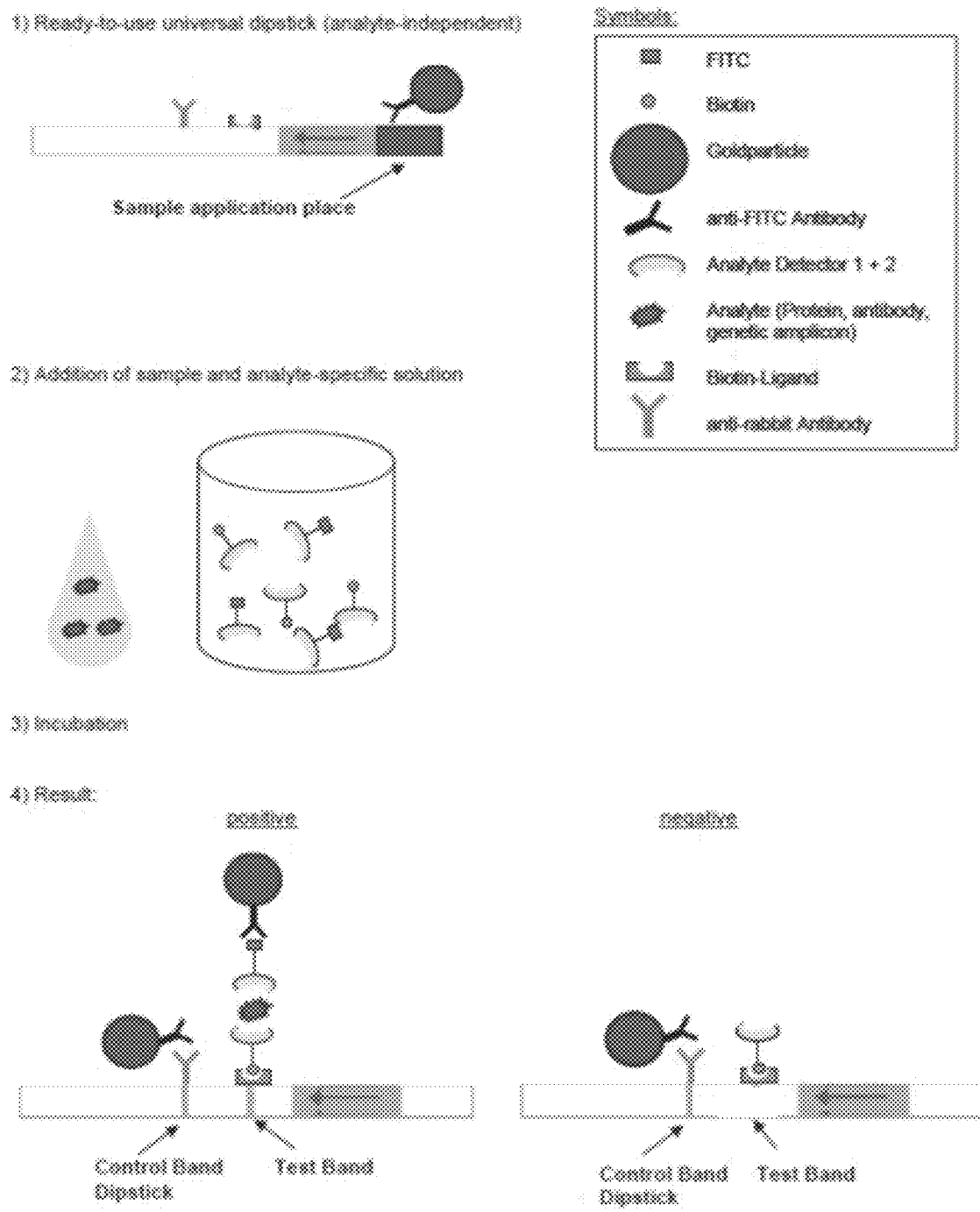
FIG. 70 shows the layout of a Milenia commercial strip with a typical reporter.

FIG. 70 shows the layout of a Milenia commercial strip with a typical reporter. This schematic shows an analyte-independent universal dipstick with a sample application region at right followed by a wicking region immediately to the left, followed to the left by a region containing a biotin ligand, followed to the left by a region spotted with anti-rabbit antibody. The sample and analyte-specific solution are incubated with analyte detectors bearing a biotin or FITC. Samples are run on the strip. A positive result shows two bands—the left-most band is from the control band and is due to binding of anti-FITC antibody coated gold nanoparticles to an anti-rabbit antibody. The right band is from the test band itself and is due to binding by the biotin ligand to an analyte detector bearing biotin, where the detector complexes the analyte and wherein the analyte is further complexed to another detector bearing FITC, which is then bound to the anti-FITC antibody coated gold particle. In the negative result—only one band is seen at the control line.

Figure 71:
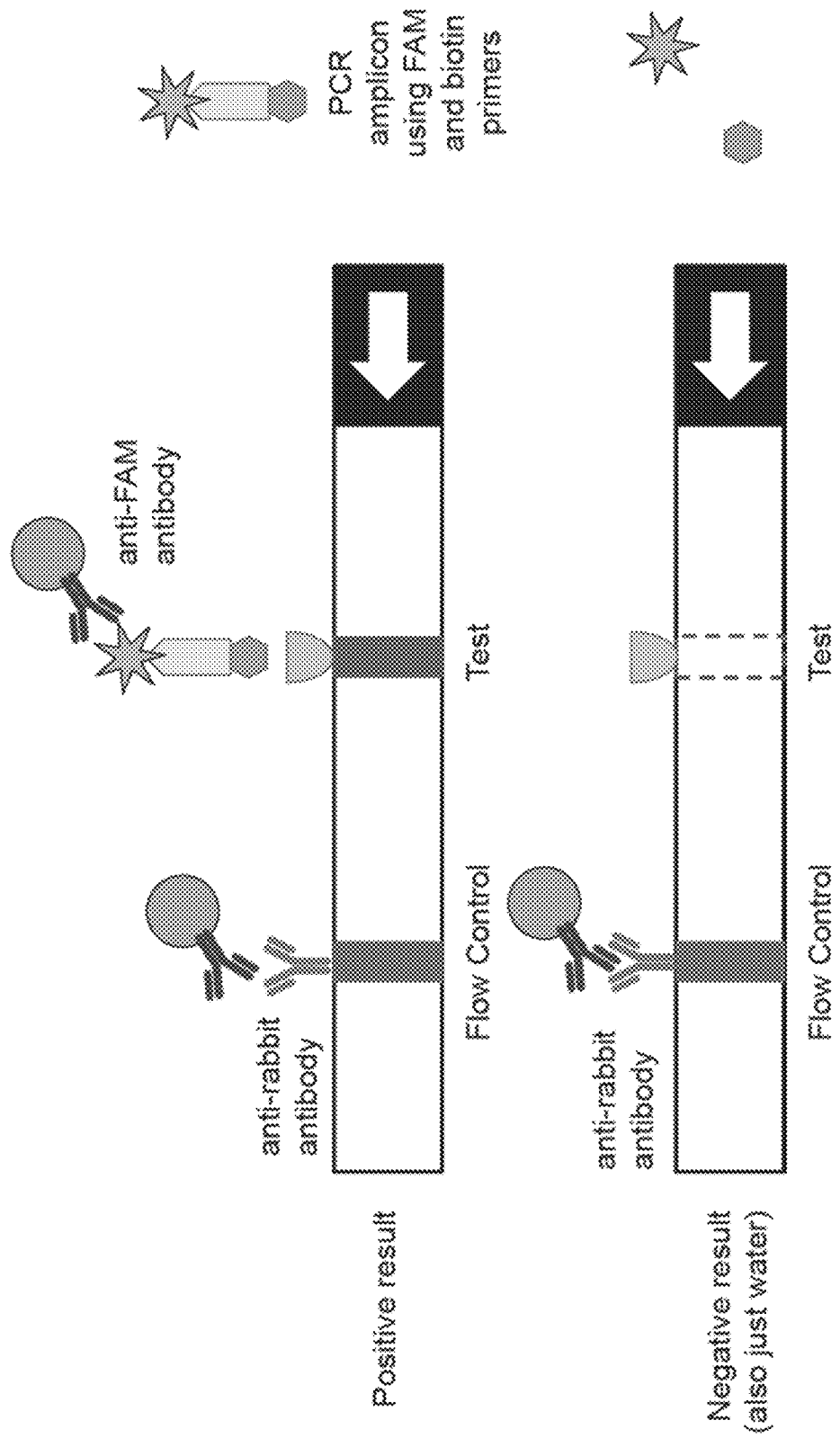
FIG. 71 shows the layout of a Milenia HybridDetect 1 strip with an amplicon.

FIG. 71 shows the layout of a Milenia HybridDetect 1 strip with an amplicon. This schematic shows at top PCR amplicon using FAM and biotin primers at the right end of the top figure. In the case of a positive result, the strip shows two bands—this PCR amplicon binds to a moiety immobilized at the test line, and the FAM molecule (shown as a start) binds to an anti-FAM antibody coated particle. To the left of the test line is a flow control line, containing anti-rabbit antibody which binds to anti-FAM antibody coated nanoparticles. In the case of a negative result, the strip shows one band—that is, just binding of anti-FAM antibody coated nanoparticles bound to anti-rabbit antibody immobilized on the test strip.

Figure 72:
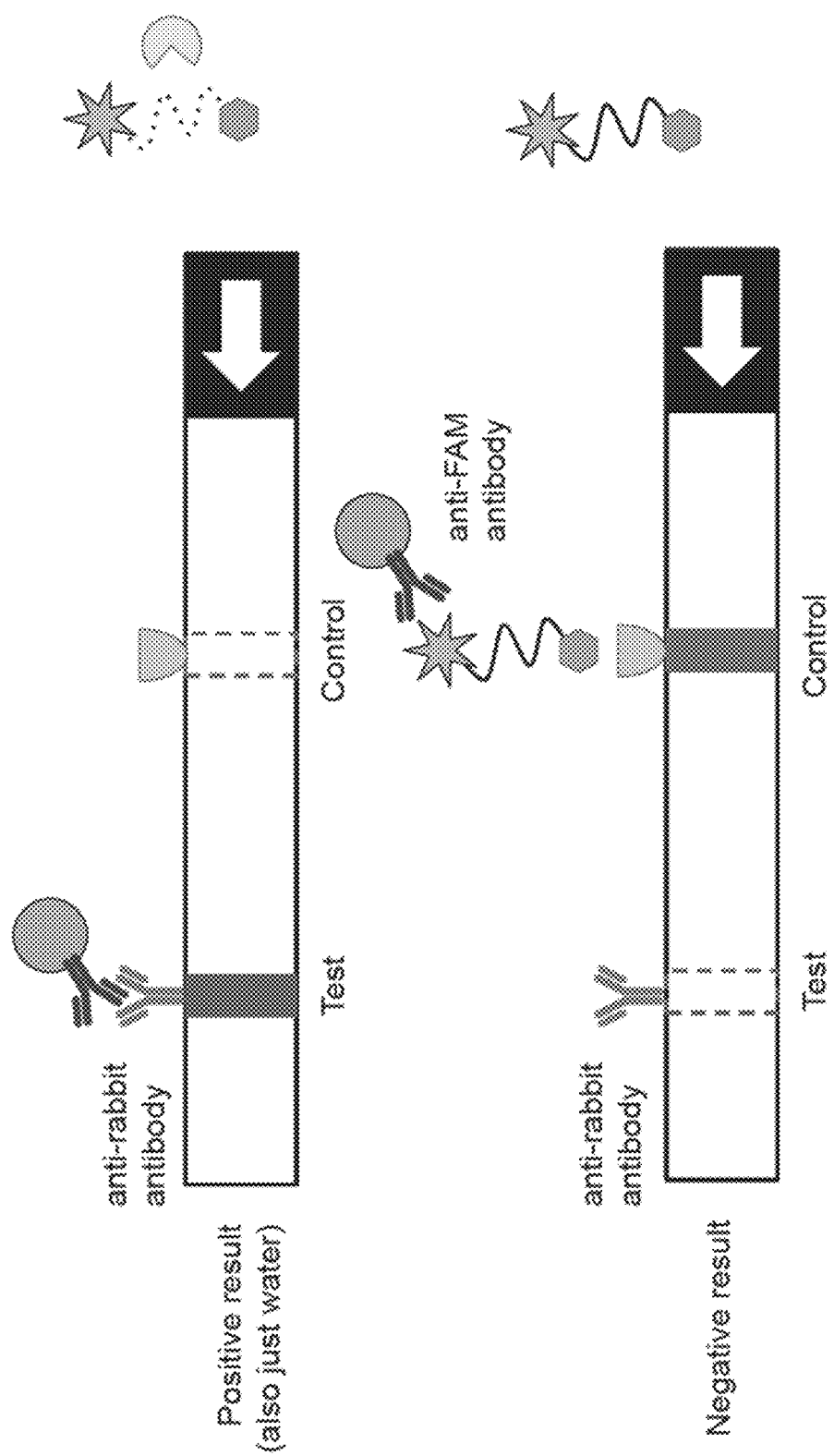
FIG. 72 shows the layout of a Milenia HybridDetect 1 strip with a standard Cas reporter.

FIG. 72 shows the layout of a Milenia HybridDetect 1 strip with a standard Cas reporter. A positive result is shown at top where a Cas protein cleaves the standard reporter, and only one band is seen—due to binding of the anti-FAM antibody coated nanoparticles to anti-rabbit antibody spotted on the strip. A negative result is shown at bottom where the intact reporter binds to a moiety immobilized on the strip, and all of the anti-FAM antibody coated nanoparticles bind at the control line to the FAM molecule on the intact Cas reporter. Results of running samples with target nucleic acids and with a water only control showed that even with the water only control, a false positive band appeared at the test line.

FIG. 73 shows a modified Cas reporter comprising a DNA linker to biotin-dT (shown as a pink hexagon) bound to a FAM molecule (shown as a green star). This entire modified Cas reporter was conjugated to magnetic beads or the surface of the reaction chamber, which was upstream of the strip. This is shown in the schematic as immobilization of the modified Cas reporter to the substrate of the DETECTR chamber/bead. During cleavage by a Cas (shown as a yellow pac-man), the biotin-FAM molecule is released from the DNA linker. Unlike other assay formats, this particular assay format contains the entire Cas cleavage reaction to the reaction chamber. In this assay format, the test-line is the actual test line and the control line is a true control line. FIG.

74 shows the layout of Milenia HybridDetect strips with the modified Cas reporter. At top, a positive result is shown, where in the Cas reaction chamber, the Cas protein cleaves the DNA linker segment of the modified Cas reporter. The biotin-dT/FAM molecule is released and flows down the test strip binding to streptavidin coated on the test line. An anti-FAM antibody coated gold nanoparticle binds to the biotin-DT/FAM reporter at the test line. Additionally the anti-FAM antibody coated gold nanoparticle binds to anti-rabbit antibody coated at the flow control line. At bottom, a negative result is shown where only the anti-FAM antibody coated gold nanoparticle binds to anti-rabbit antibody coated at the flow control line.

Figure 75:
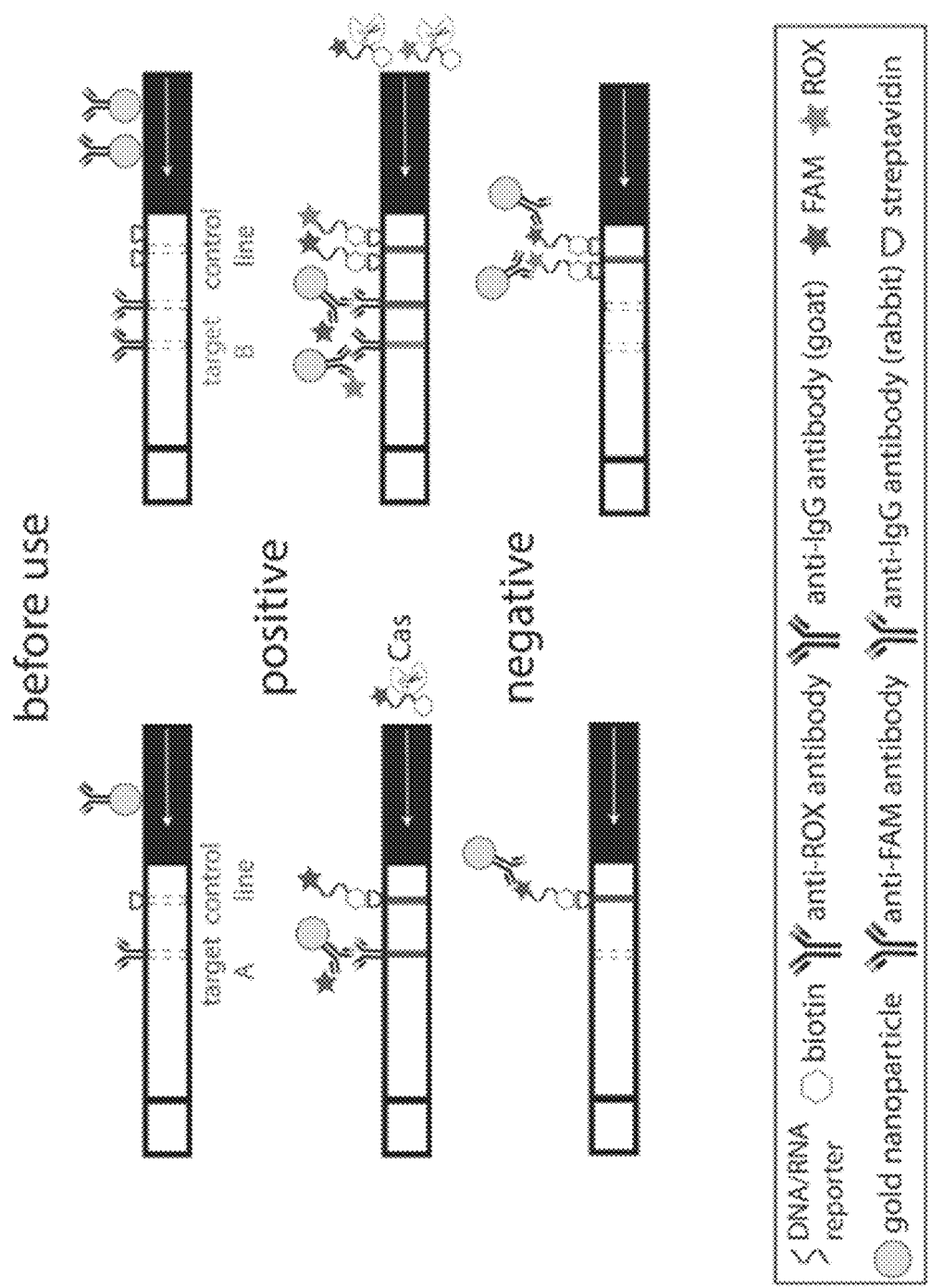

FIG. 75 shows an example of a single target assay format (to left) and a multiplexed assay format (to right). At the top are diagrams showing a schematic of the assay prior to use, anti-FAM antibody coated gold nanoparticles only (on left) or anti-FAM antibody coated gold nanoparticles and anti-ROX antibody coated gold nanoparticles (to right) are upstream of the control and test lines. The control lines are spotted with streptavidin and the test lines are spotted with only target A (left) or target A and target B (right). Assays with positive results are shown in the middle schematic and assays with negative results are shown in the lowest schematic.

Figure 76:
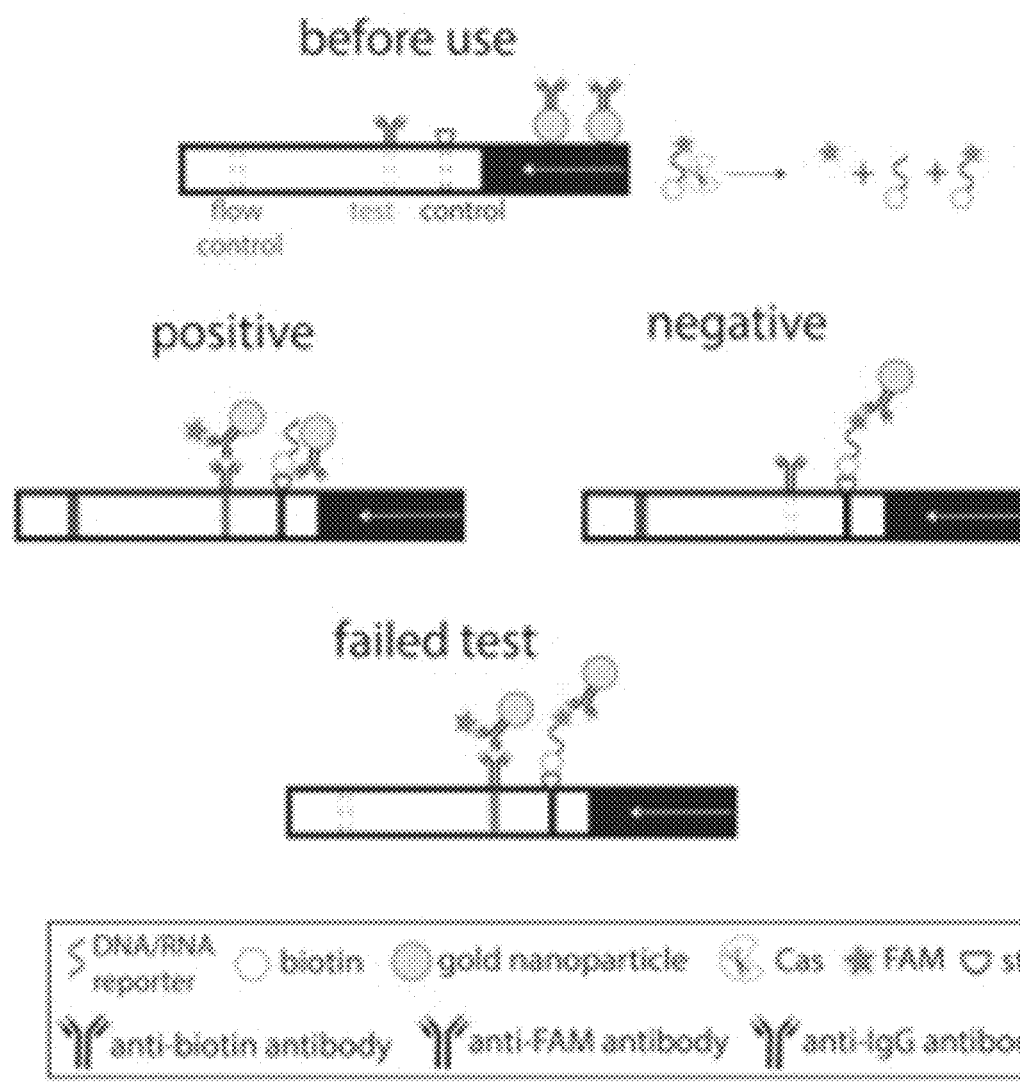

FIG. 76 shows another variation of an assay prior to use (top), an assay with a positive result (middle left), an assay with a negative result (middle right), and a failed test (bottom). In this assay the flow control is at the left most end of the strip, followed by the test line coated with anti-IgG rabbit antibody, followed by the control line coated with streptavidin, followed by gold nanoparticles coated with anti-FAM or anti-biotin antibodies. The Cas reporters are upstream of the strip in a reaction chamber. If cleaved the Cas reporter is cleaved (positive result), FAM molecules bind to the anti-FAM coated gold nanoparticles, which subsequently bind at the test line and anti-biotin antibody coated nanoparticles bind at the control line to the DNA/RNA linker/biotin construct. If the Cas reporter is not cleaved (negative result), the intact reporter binds to streptavidin at the control line, where they are subsequently bound by anti-FAM coated gold nanoparticles.

Gold nanoparticle conjugation to anti-biotin antibody. A 100 µl aliquot of anti-biotin antibody was used, with the antibody suspended in nuclease free water. 7 µl of the dilute antibody in solution was added to tubes and reactions were incubated for 30 min in a shaking incubatory at room temperature. The reaction in each tube was stopped with the addition of 50 µl of the BSA blocked buffer and the tubes were stored at 4C.

Example 37

Conjugation of Oligonucleotides to Peptides/Enzymes for Downstream Use in an Invertase-Coupled Assay for Amperometric Detection of Target Nucleic Acids Using Programmable Nuclease Systems This example describes a conjugation method for oligonucleotides to peptides/enzymes for downstream use in an invertase coupled assay for amperometric detection of reactions using a programmable nuclease system. Here, DETECTR reactions using CRISPR-Cas systems were used as the reactions using a programmable nuclease system. The methods disclosed herein were developed as alternatives to fluorescence and lateral-flow-immunochromatography readouts of DETECTR reactions and include efficient conjugation of an invertase enzyme to a DETECTR reporter using a 3' thiol modification. The CRISPR-Cas reporter molecule for use in the invertase-coupled assay for amperometric detection of DETECTR reactions includes (1) a 5'-Biotin moiety and (2) a 3'-invertase enzyme. The sequence of the oligo was /5Biosg/TTTTTTTTTTTTTTTTTTTTT/3ThioMC3-D/ (SEQ ID NO: 169) and the invertase enzyme was conjugated at the 3' end. Reagents for the conjugation included invertase from Baker's yeast (S. Cerevisiae, Sigma #I4504), streptavidin magnetic beads (NEB #S1420S), Tris (2-carboxyethyl)phosphine hydrochloride (TCEP, Sigma #C4706), N-Succinimidyl 4-(maleimidomethyl)cyclohexanecarboxylate, SMCC (SMCC, Sigma #M5525), 1M sodium phosphate buffer, pH 7.2 (Tecnova, #P2072), 2-(NMorpholino)ethanesulfonic acid (MES, Sigma #76039), sodium chloride 5M sterile (VWR #E529), and biotin labelled oligos.

Buffer and solution preparation. Buffers prepared included (1) 0.1M Phosphate Buffer, no NaCl, pH 7.2, (2) 0.1M Phosphate Buffer, 0.1M NaCl, pH 7.2, (3) 0.05M MES Buffer, pH 5.5, and (4) 0.05M MES Buffer, with 0.1M NaCl, pH 5.5. TCEP solution, SMCC solution, and invertase solution was prepared from solids. The DNS reagent was also prepared.

Thiol activation of DNA oligo. The thiol-biotin-labelled oligos (15 µL, 1 mM in water) were mixed with TCEP (3 µL, 0.5M in water) in a 1.5-mL microcentrifuge tube. The reaction volume was made up to 30 µL with the addition of 12 µL of equivalent buffer. The following twelve reactions were prepared: MB406 with low pH, no salt buffer; MB406 with low pH and salt buffer; MB406 with PBS, no salt; MB406 with PBS and salt buffer; MB407 with low pH, no salt buffer; MB407 with low pH and salt buffer; MB407 with PBS, no salt; MB407 with PBS and salt buffer; MB408 with low pH, no salt buffer; MB408 with low pH and salt buffer; MB408 with PBS, no salt; and MB408 with PBS and salt. In each buffer, the volume of DNA oligos was 15 µL, the volume of TCEP was 3 µL, and the volume of buffer was 12 µL. The reaction was incubated for 3-5 hours in the shaking incubator at 37° C. The reaction was stopped by snap freezing in liquid nitrogen. Microcentrifuge tubes were stored at −20° C. until the next step of the reaction. Thiol-activated oligo tubes were removed from the freezer 3 hours prior to conjugation to activated invertase/or other activated proteins/peptides. The tube was first incubated at 37° C. for 3 hours and then used in the conjugation reaction SMCC activation of invertase enzyme. A fresh solution of invertase lab stock bottle was prepared. 10 mg of solid was weighed in a clean 1.5 mL microcentrifuge tube, 860 µL of buffer A (0.1M NaCl, 0.1M sodium phosphate buffer, pH 7.2) was added to make a solution of 20 mg/mL. 1 mg of SMCC was added to a 1.5 mL microcentrifuge tube and the reaction was initiated by addition of invertase solution (400 µL, 20 mg/mL in 0.1M NaCl, 0.1M sodium phosphate buffer, pH 7.2). The reaction was incubated in the shaking incubator at 37° C. for 24 hours.

Cleanup of SMCC-activated invertase. The reaction was removed from the shaking incubator (37° C.) after 23 hours and 15 minutes. SMCC-activated invertase was washed 8× and resuspended in 400 µL of buffer. Protein was quantified by the BCA method. Samples were resuspended in either MES buffer with salt (sample MNT-1), MES buffer without salt (sample MNT-2), or PBS without salt (sample MNT-3).

Re-activation of thiol-DNA oligo. The oligo was removed from −20° C. and incubated in the shaking incubator at 37° C. The reaction was initiated and incubated in the shaking incubator (37° C.) for 48 hours. The reaction was removed from the incubator and each reaction contained (1) 35 µL of invertase solution, and (2) 30 µL of thiol-DNA oligo solution.

Binding with streptavidin beads. 12.5 µL of streptavidin beads was mixed with 50 µL of the biotinylated DNA oligo previously conjugated with invertase enzyme in a 1.5-mL microcentrifuge tube. The reaction was incubated for 5 minutes at room temperature, beads were washed 5× with 50-µL aliquots of Buffer A on a magnetic rack to remove any unbound DNA oligo from the solution, and eluent from all the washes was checked for invertase activity (and thus inefficient binding between streptavidin and biotin molecules). During the last wash, beads were resuspended with 50 µL of Buffer A and beads were stored at 4° C.

Incubation with DNS/Sucrose. A reaction was prepared containing 5 µL of 20% sucrose, 30 µL DNS reagent, 25 µL of biotinylated DNA with invertase moiety. A color change was observed after incubation at high heat (95C).

DNA-Invertase Conjugation. Conjugation was carried out using a heterobifunctional linker sulfo-SMCC. To 30 µl of 1 mM thiol-DNA in Millipore water, 2 µl of 1 M sodium phosphate buffer at pH 5.5 and 2 µl of 30 mM TCEP in Millipore water were added and mixed. This mixture was kept at room temperature for 1 hour and then purified by Amicon-10K using Buffer A (0.1 M NaCl, 0.1 M sodium phosphate buffer, pH 7.3, 0.05% Tween-20) without Tween-20 by 8 times. For invertase conjugation, 400 µl of 20 mg/mL invertase in Buffer A without Tween-20 was mixed with 1 mg of sulfo-SMCC. After vortexing for 5 minutes, the solution was placed on a shaker for 1 hour at room temperature. The mixture was then centrifuged and the insoluble excess sulfo-SMCC was removed. The clear solution was then purified by Amicon-100K using Buffer A without Tween-20 by 8 times. The purified solution of sulfo-SMCC-activated invertase was mixed with the above solution of thiol-DNA. The resulting solution was kept at room temperature for 48 hours. To remove un-reacted thiol-DNA, the solution was purified by Amicon-100K 8 times using Buffer A without Tween-20. Conjugation was also carried out using homobifunctional linker PDITC. To 60 µl of 1 mM amine-DNA in Millipore water, 30 µl of Buffer B (0.1 M sodium borate buffer, pH 9.2) were added and mixed. This solution was further mixed with 20 mg of PDITC dissolved in 1 mL DMF. The resulting solution was placed on a shaker and kept at room temperature in the dark for 2 hours. After that, the solution was mixed with 6 mL of Millipore water and 6 mL 1-butanol. After centrifuging for 15 min, the upper organic phase was discarded. The aqueous phase was then extracted with 4 mL 1-butanol three times, and purified by Amicon-10K using Buffer A without Tween-20 for 8 times to produce a PDITC-activated amine-DNA solution. The PDITC activation ratio was over 90% according to a MALTI-TOF mass spectrum obtained after desalting the DNA product. Then, 10 mg of invertase were added to the activated DNA solution in Buffer A without Tween-20 to reach a final concentration about 5 mg/mL. The resulting solution was kept at room temperature for 48 hours. To remove un-reacted PDITC-activated amine-DNA, the solution was purified by Amicon-100K 8 times using Buffer A without Tween-20. Results of the conjugation showed that (1) Tween was not necessary for invertase activity; (2) 1 mg/ml invertase reaction likely finished after 5 min; (3) 2% sucrose input produces red color at RT after ~15 min; and (4) DNS was not effective for <0.2% sucrose.

Thiol Reduction of Biotin-SG and Conjugation with Invertase/SMCC. The reaction was initiated by the addition of invertase solution (20 mg/mL invertase in 0.1 M NaCl, 0.1 M sodium phosphate, pH 7.2) to SMCC. SMCC activation was tested my adding 3 mg of sulfo-SMCC to either 1200 µL, 600 µL, or 60 µL of invertase solution. The reaction incubated while shaking at 37° C. for approximately 24 hours. The activation reactions were cleaned up by washing each reaction four times with 300 µL of MES buffer with salt in a 100 kDa filter. After the final wash, each sample was resuspended in 400 µL of buffer. Samples were stored at −20° C.

Conjugation of thiol-DNA oligo with SMCC-activated invertase was performed by incubating 35 µL of invertase solution with 30 µL of thiol-DNA oligo solution and incubating at 37° C. for about 48 hours.

Biotinylated DNA oligo conjugated to invertase was bound to streptavidin beads combining 12.5 µL of streptavidin beads with 50 µL of the conjugated biotin-DNA oligo. The reaction was incubated for 5 min at room temperature then washed five times with Buffer A on a magnetic rack to remove any unbound DNA oligo. Eluent from the washes was retained for further analysis. After the final wash, beads were resuspended in 50 µL of Buffer A.

Invertase activity of the biotin-DNA invertase conjugates was measured using a sucrose DNS reaction. Each tested sample was combined with sucrose and DNS reagent and incubated at 95° C. for 5 min. FIG. 99 shows the DNS sucrose reaction for different tested conditions. The top row from left to right shows the test conditions: 1 µM oligo, 1 mg/mL invertase; 1 µM oligo, 10 mg/mL invertase; 1 µM oligo, 20 mg/mL invertase; 1 µM oligo, 1 mg/mL invertase eluent; 1 µM oligo, 10 mg/mL invertase eluent; 1 µM oligo, 20 mg/mL invertase eluent. The middle row from left to right shows the test conditions: 10 µM oligo, 1 mg/mL invertase; 10 µM oligo, 10 mg/mL invertase; 10 µM oligo, 20 mg/mL invertase; 10 µM oligo, 1 mg/mL invertase eluent; 10 µM oligo, 10 mg/mL invertase eluent; 10 µM oligo, 20 mg/mL invertase eluent; glucose positive control. The bottom row from left to right shows the test conditions: 100 µM oligo, 1 mg/mL invertase; 100 µM oligo, 10 mg/mL invertase; 100 µM oligo, 20 mg/mL invertase; 100 µM oligo, 1 mg/mL invertase eluent; 100 µM oligo, 10 mg/mL invertase eluent; 100 µM oligo, 20 mg/mL invertase eluent; buffer negative control (MES with 0.1 M NaCl). A darker solution indicates more active invertase enzyme.

Example 38

Lateral Flow Cleavage Reporters for Programmable Nuclease Diagnostics

This example describes lateral flow cleavage reporters for programmable nuclease diagnostics. Here, CRISPR diagnostics were used as the programmable nuclease diagnostics. One design of the Cas reporters disclosed herein involved tethering the Cas reporter to the reaction chamber, upstream of the lateral flow test strip.

Figure 77:
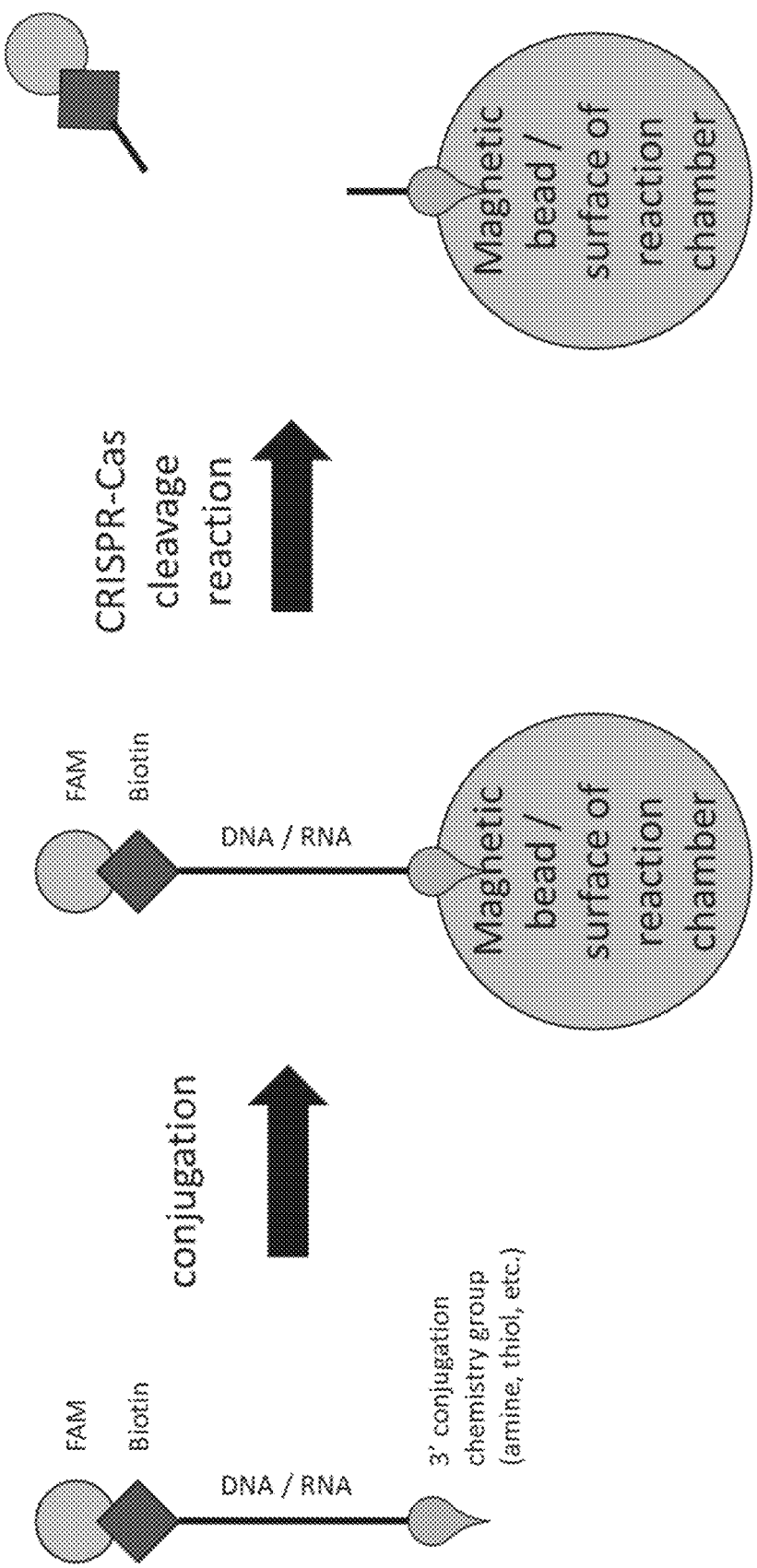

FIG. 77 shows one design of a tethered lateral flow Cas reporter. To the left is a DNA or RNA linker connecting a functional handle for chemical conjugation at the 3' end (amine, thiol, etc.) and a biotin at the 5' end (shown as a diamond) further connected to a FAM reporter molecule. This entire Cas reporter was conjugated to a magnetic bead and immobilized to the surface of the reaction chamber. After CRISPR-Cas cleavage reactions, the DNA/RNA linker was cleaved and the biotin/FAM reporter moiety is released.

Figure 78:
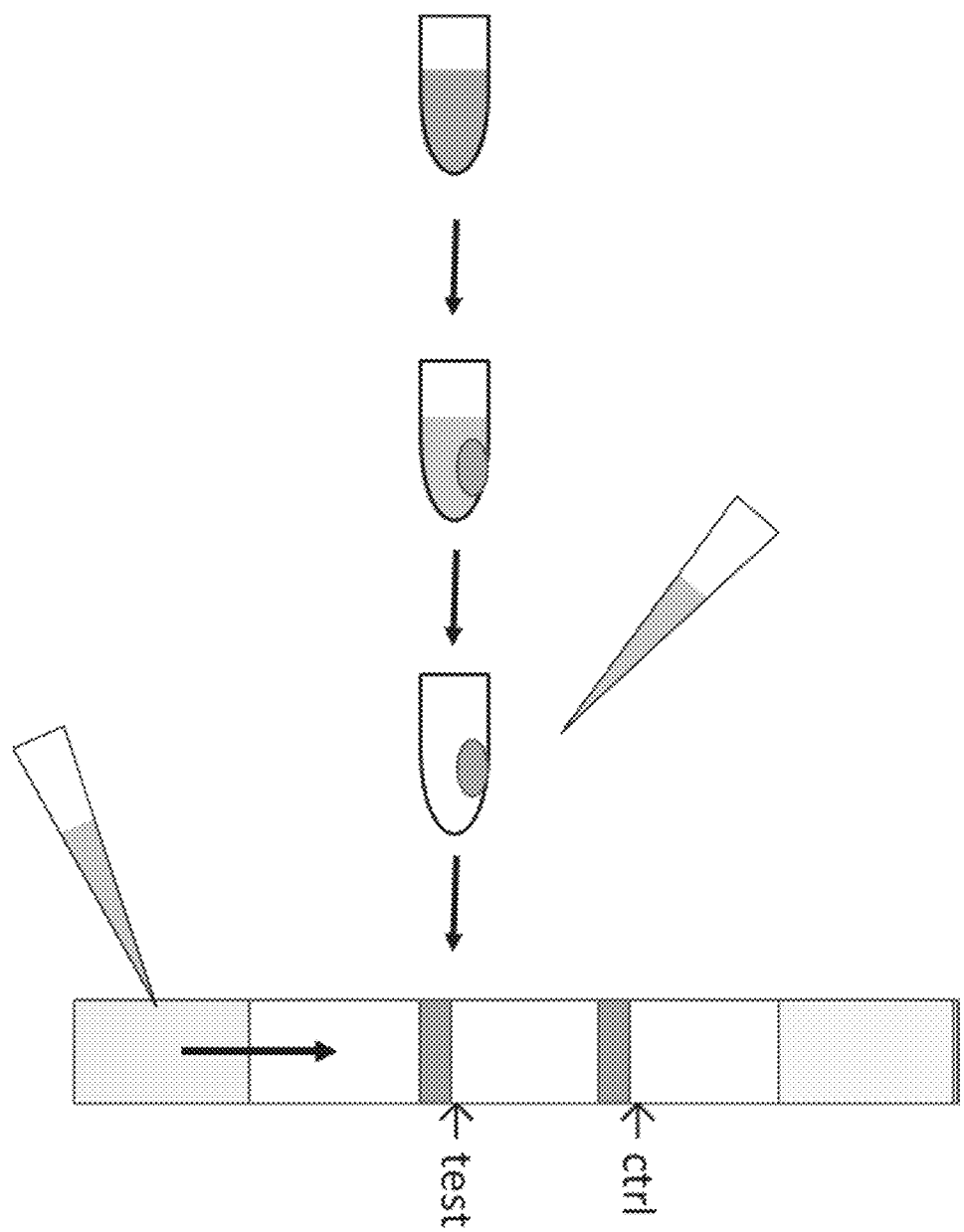

FIG. 78 shows a workflow for CRISPR diagnostics using the tethered cleavage reporter using magnetic beads. First, CRISPR-Cas protein RNPs were incubated with target nucleic acids and magnetic beads were conjugated to the reporter. Magnetic beads were captured with a magnet, the supernatant was removed, and the sample was placed on a lateral flow strip with chase buffer.

Figure 79A:
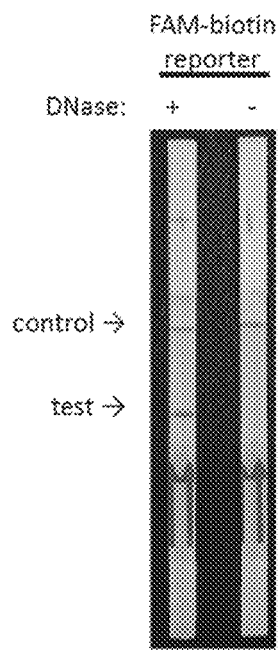
Figure 79B:
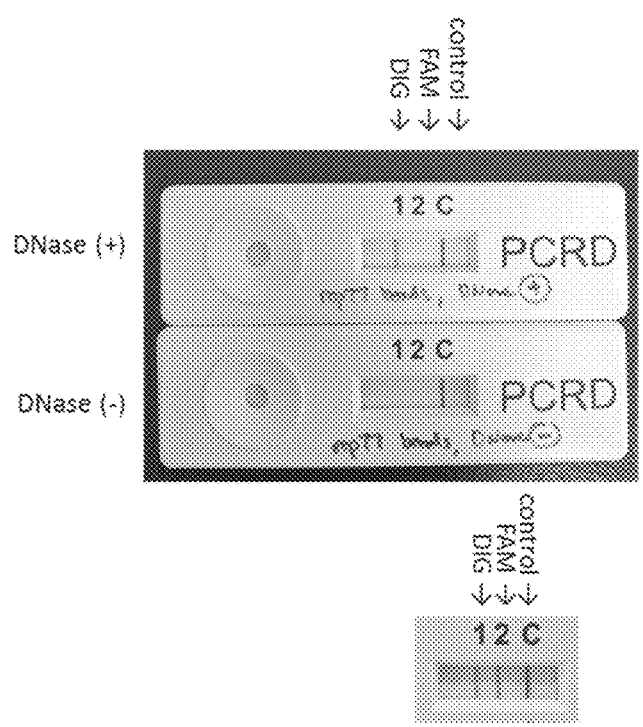
Figure 79C:
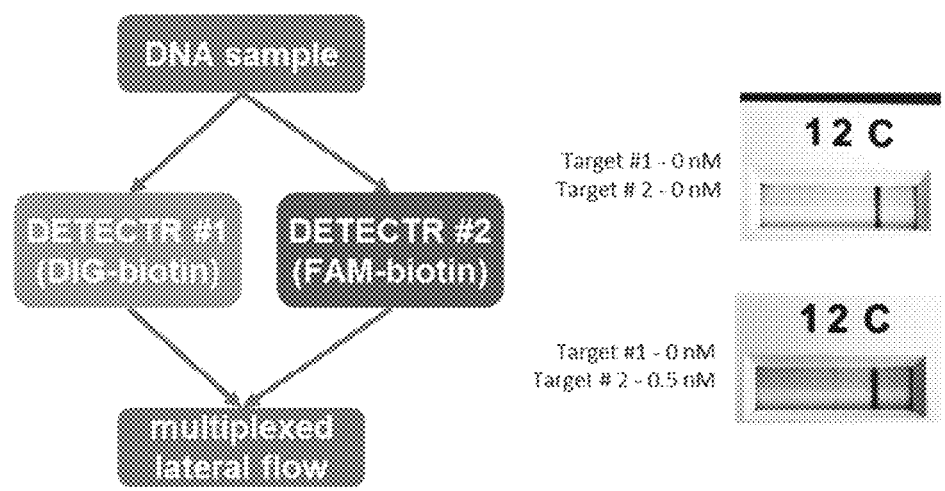

FIG. 79A shows a FAM-biotin reporter conjugated to magnetic beads, further incubated in the presence or absence of TURBO DNase (Thermo) for 15 minutes at 37 C. After the incubation period the magnetic beads were pelleted and the supernatant was transferred to a Milenia HybridDetect lateral flow strip (TwistDx). FIG. 79B shows a DIG-biotin reporter, which was conjugated to magnetic beads and incubated in the presence or absence of TURBO DNase (Thermo) for 15 minutes at 37 C. After the incubation period the magnetic beads were pelleted and the supernatant was transferred to a PCRD lateral flow strip (Abingdon Health). The bottom panel shows an example of a lateral flow device for multiplexed detection of FAM-biotin and DIG-biotin reporters that were conjugated to magnetic beads. FIG. 79C shows a FAM-biotin and DIG-biotin reporters conjugated to magnetic beads. Reporter conjugates were incubated with Cas12M08 for 30 min at 37° C. in the presence or absence of 0.5 nM target DNA in two separate DETECTR reactions. After the incubation period, the magnetic beads were pelleted, and the supernatant was transferred to a PCRD lateral flow strip (Abingdon Health). Results showed a detection of a specific signal only when the target DNA was included in the reaction, as seen in for Target #2 (FAM-biotin) in the bottom test strip.

Figure 80:
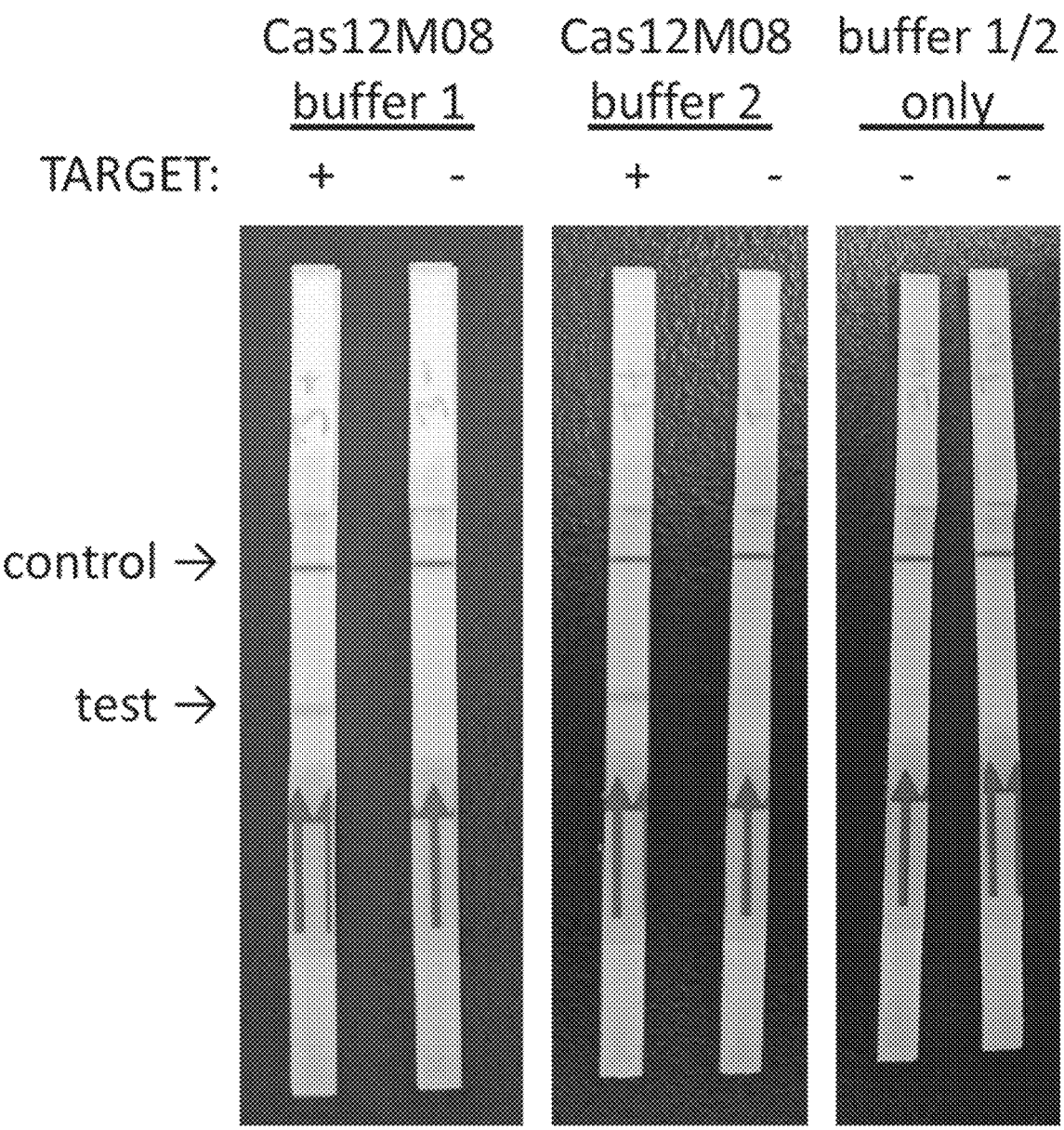

FIG. 80 shows photographs of test strips where a tethered cleavage reporter was released by CRISPR-Cas proteins. FAM-biotin reporter conjugated to magnetic beads was incubated with Cas12M08 for 30 minutes at 37 C in the presence or absence of target DNA (~0.5 nM). Two buffers were tested: buffer 1=MBuffer3, buffer 2=TURBO DNase buffer. The buffers without enzyme or target were also tested. After the incubation period the magnetic beads were pelleted and the supernatant transferred to a Milenia Hybrid-Detect lateral flow strip (TwistDx).

Tethered cleavage reporters can also be used to multiplex readouts from CRISPR diagnostics. FAM-biotin and DIG-biotin reporter conjugated to magnetic beads was incubated with Cas12M08 for 30 minutes at 37 C in the presence or absence of target DNA (~0.5 nM) in two separate DETECTR reactions. After the incubation period the magnetic beads were pelleted and the supernatant transferred to a PCRD lateral flow strip (Abingdon Health).

Figure 81:
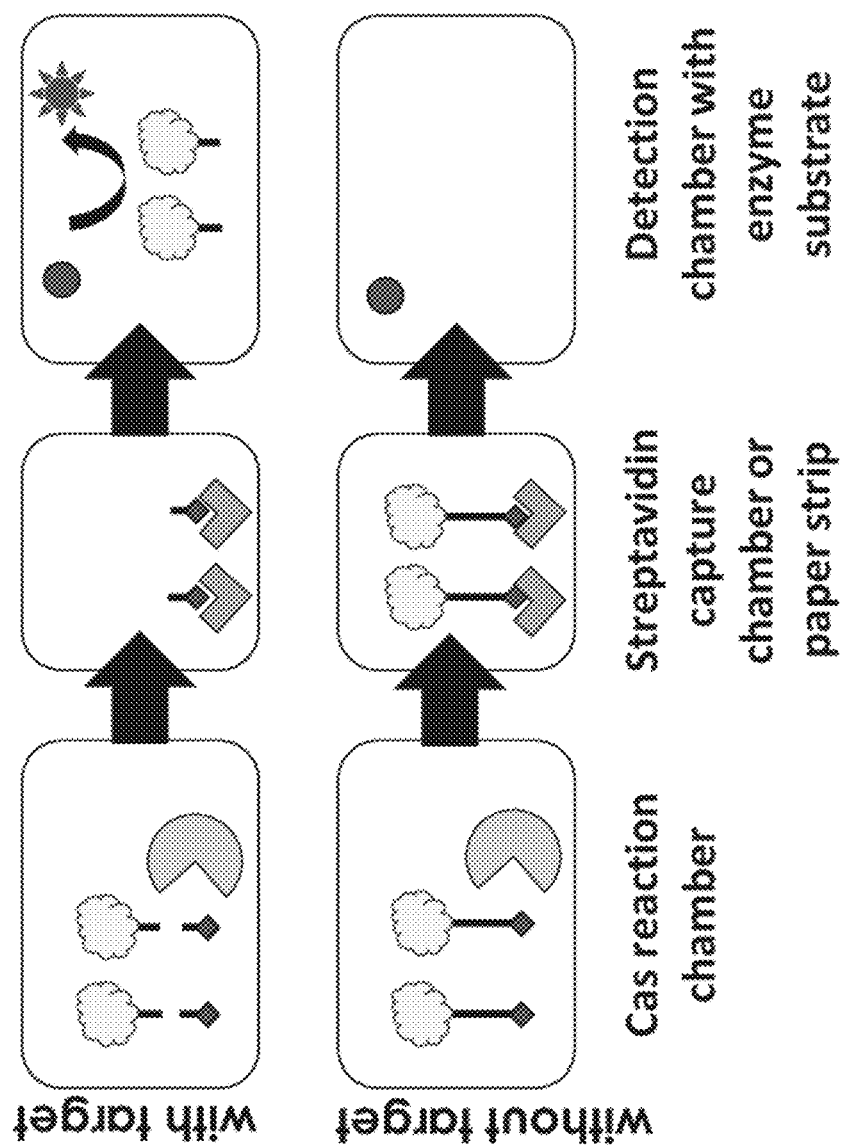
Figure 81:
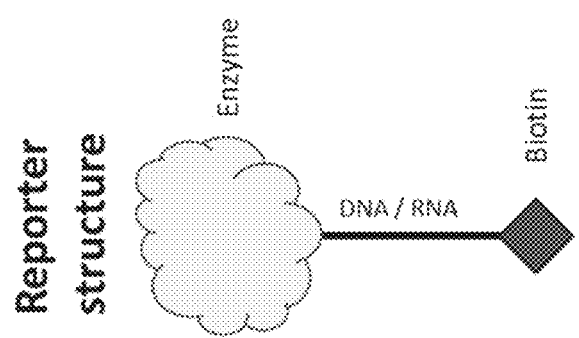

FIG. 81 shows a schematic for an enzyme-reporter system that is filtered by streptavidin-biotin before reaching the reaction chamber. The reporter structure is shown at left and includes a DNA/RNA linker connecting biotin and an enzyme. In the presence of the target (shown at top), Cas proteins cleave the linker in the Cas reaction chamber, leading to binding of biotin to the streptavidin inside of a capture chamber or on a paper strip, and enzymatic activity exhibited in a detection chamber containing the enzyme's substrate. In the absence of the target (shown at bottom), Cas proteins do not cleave the linker in the Cas reaction chamber, leading to binding of the full reporter inside of the capture chamber, and no enzyme (thus, no enzymatic activity) in the detection chamber containing the enzyme's substrate.

Example 39

Invertase-Nucleic Acid as a Detector Nucleic Acid

This example shows an invertase-nucleic acid as a detector nucleic for detection of a target nucleic acid in a programmable nuclease system.

FIG. 82 shows an invertase-nucleic acid used for the detection of a target nucleic acid. The invertase-nucleic acid, immobilized on a magnetic bead, is added to a sample reaction containing Cas protein, guide RNA, and a target nucleic acid. Target recognition activates the Cas protein to cleave the nucleic acid of the invertase-nucleic acid, liberating the invertase enzyme from the immobilized magnetic bead. This solution is either be transferred to the "reaction mix", which contains sucrose and the DNS reagent and changes color from yellow to red when the invertase converts sucrose to glucose or is can be transferred to a hand-held glucometer device for a digital readout.

FIGS. 83A-83C shows an example color change readout by invertase-nucleic acids in reaction mix. DNS reagent produces a colorimetric change when invertase converts sucrose to glucose. Free invertase at 0.4 or 4 uM was reacted with 0-60 mM sucrose for 5, 10, 15 or 30 min at room temperature, and samples were heated at 95 C for 10 sec to enhance the color change.

Example 40

Enzyme Substrate-Nucleic Acid as a Detector Nucleic Acid

This example shows an enzyme substrate-nucleic acid as a detector nucleic for detection of a target nucleic acid in a programmable nuclease system.

The enzyme substrate-nucleic acid is connected to one of two electrodes. Upon activation of the programmable nuclease (eg. Cas12, Cas13 or Cas14) the enzyme substrates are cleaved from the electrode, resulting in decreased conductance between the electrodes. This resulting change can be measured by a device such as a glucometer.

Example 41

Sterically Hindered Enzyme-Nucleic Acid as a Detector Nucleic Acid

This example shows a sterically hindered enzyme-nucleic acid as a detector nucleic for detection of a target nucleic acid in a programmable nuclease system.

A detector nucleic acid comprises an enzyme linked by a nucleic acid (e.g., a ssDNA, ssRNA or a ssDNA/RNA hybrid) to a surface. This enzyme is inhibited sterically by being tethered to the surface, until cleavage of the nucleic acid is initiated by binding of the programmable nuclease complexed to a guide nucleic to a target nucleic acid. Release of the enzyme by the cleavage results in the enzyme regaining is function, which can be detected by conversion of the enzyme's substrate to a product that results in color, fluorescence, or electrochemical readout.

Example 42

Assay Layouts and Workflows for Programmable Nuclease Systems

This example describes assay layouts and workflows for programmable nuclease systems. Here, DETECTR reactions were used in the programmable nuclease systems. An assay is provided that comprises separate chambers for amplification and reverse transcription versus a programmable nuclease-based detection assay. The programmable nuclease is a Cas12, Cas13, or Cas14. The sample is a biofluid collected by a swab and inserted into a swab collection reservoir. A pump drives the fluidics in the assay moving sample from chamber to chamber. A detectable signal is colorimetric, fluorescence-based, electrochemical and/or generated using an enzyme (e.g., invertase).

FIG. 84 shows one layout for a DETECTR assay. In this layout a swab collection cap seals a swab reservoir chamber. Clockwise to the swab reservoir chamber is a chamber holding the amplification reaction mix. Clockwise to the chamber holding the amplification reaction mix is a chamber holding the DETECTR reaction mix. Clockwise to this is the detection area. Clockwise to the detection area is the pH balance well. A cartridge wells cap is shown and seals all the wells containing the various reagent mixtures. The cartridge itself is shown as a square layer at the bottom of the schematic. To the right is a diagram of the instrument pipette pump which drives the fluidics in each chamber/well and is connected to the entire cartridge. Below the cartridge is a rotary valve that interfaces with the instrument. FIG. 85 shows one workflow of the various reactions in the DETECTR assay of FIG. 84. First, as shown in the top left diagram, a swab may be inserted into the 200 µl swab chamber and mixed. In the middle left diagram, the valve is rotated clockwise to the "swab chamber position" and 1 µL of sample is picked up. In the lower left diagram, the valve is rotated clockwise to the "amplification reaction mix" position and the 1 µl of sample is dispensed and mixed. In the top right diagram, 2 µL of sample is aspirated from the "amplification reaction mix". In the right middle diagram, the valve is roated clockwise to the "DETECTR" position, the sample is dispensed and mixed, and 20 µl of the sample is aspirated. Finally, in the bottom right diagram, the valve is rotated clockwise to the detection area position and 20 µl of the sample is dispensed. While the rotary valve is in a closed position, the sample is loaded into the swab lysis chamber and sealed using the cap. The sample is then incubated and mixed by the instrument with the lysis buffer. Following sample lysis, the rotary valve turns to align with the sample well and aspirates 2 to 4 µL of sample. The rotary valve then turns to align with the amplification chamber, where the sample is mixed with the amplification mixture. The sample is then aspirated, and the rotary valve rotates to the DETECTR chamber. In the DETECTR chamber, the sample mixes with the DETECTR mix. Actuation of the pipette pump mixes the reaction mixtures. The process may then be repeated from the amplification chamber to a second DETECTR chamber.

FIG. 86 shows a modification of the workflow shown in FIG. 85 that is also consistent with the methods and systems of the present disclosure. At left is the diagram shown at the top right of FIG. 85. At right is the modified diagram in which there is a first amplification chamber counterclockwise to the swab lysis chamber and a second amplification chamber clockwise to the swab lysis chamber. Additionally, clockwise to amplification chamber #2 are two sets, or "duplex," DETECTR chambers labeled "Duplex DETECTR Chambers #2" and "Duplex DETECTR Chambers #1," respectively. FIG. 87 shows breakdown of the workflow for the modified layout shown in FIG. 86. Specifically, from the swab lysis chamber, which holds 200 µl of sample, 20 µl of the sample can be moved to amplification chamber #1 and 20 µl of the sample can be moved to amplification chamber #2. After amplification in amplification chamber #1, 20 ul of the sample can be moved to Duplex DETECTR Chambers #1a and 20 µl of the sample can be moved to Duplex DETECTR Chambers #1b. Additionally, after amplification in amplification chamber #2, 20 µl of the sample can be moved to Duplex DETECTR Chambers #2a and 20 µl of the sample can be moved to Duplex DETECTR Chambers #2b.

FIG. 88 shows the modifications to the cartridge illustrated in FIG. 86 and FIG. 87. FIG. 89 shows a top down view of the cartridge of FIG. 88. This layout and workflow has a replicate in comparison to the layout and workflow of FIGS. 84-85. FIG. 90 shows a layout for a DETECTR assay. Shown at top is a pneumatic pump, which interfaces with the cartridge. Shown at middle is a top down view of the cartridge showing a top layer with reservoirs. Shown at bottom is a sliding valve containing the sample and arrows pointing to the lysis chamber at left, following by amplification chambers to the right, and DETECT chambers further to the right. FIG. 102 shows a schematic of the sliding valve device. FIG. 103 shows a layout and workflow for a sliding valve device. In the initial closed position (i.), the sample is loaded into the sample well and lysed. The sliding valve is then actuated by the instrument, and samples are loaded into each of the channels using the pipette pump, which dispenses the appropriate volume into the channel (ii.). The sample is delivered to the amplification chambers by actuating the sliding valve and mixed with the pipette pump (iii.). Samples from the amplification chamber are aspirated into each channel (iv.) and then dispensed and mixed into each DETECTR chamber (v.) by actuating the sliding valve and pipette pump.

Example 43

Hotspot Lung Cancer Assay

This example describes a hotspot lung cancer assay. The hotspot lung cancer assay is carried out using either a one-pot or two-pot workflow. A sample is taken from a subject. The subject is a human or non-human animal. The sample is a biofluid, such as a blood sample, a serum sample, a plasma sample, a saliva sample, a urine sample, a sputum sample, a mucosal sample, a peritoneal fluid sample, a tissue sample, an exudate, an effusion, or a cell free DNA sample. The assay comprises a programmable nuclease that binds to and is activated by a target nucleic acid. The target nucleic acid comprises a mutation, or "hotspot", in a gene correlated with lung cancer. The target nucleic acid is optionally amplified and the activated programmable nuclease cleaves a reporter that generates a detectable signal. Generation of the detectable signal indicates presence of hotspot mutations of nucleic acids in a sample from a subject, indicating lung cancer.

Example 44

Programmable Nuclease System Assays Versus PCR-Based Detection

This example describes a comparison of the programmable nuclease system assays disclosed herein to the gold standard: PCR-based methods of detecting a target nucleic acid. Here, a DETECTR reaction was used in the programmable nuclease system assay. Samples were either used as a crude prep for DETECTR assays (only lysed) or purified (lysed, bound, washed, and eluted) for PCR-based methods of detection. A DETECTR assay using a programmable nuclease (e.g., a Cas protein) was carried out on the crude sample. The programmable nuclease was activated by the target nucleic acid in a sample to which it binds via a reverse complementary guide RNA. The activated programmable nuclease indiscriminately cleaves a reporter generating a fluorescent detectable signal. Standard PCR-based methods were used to also detect the target nucleic acids in the sample.

FIG. 91 shows a comparison of the DETECTR assays disclosed herein to the gold standard PCR-based method of detecting a target nucleic acid. Shown at top is a flow chart showing a gradient of sample prep evaluation from crude (left) to pure (right). Sample prep steps that take a crude sample to a pure sample include lysis, binding, washing, and eluting. DETECTR assays disclosed herein may only need the sample prep step of lysis, yielding a crude sample. On the other hand, PCR-based methods can require lysis, binding, washing, and elution, yielding a very pure sample. The graph at bottom shows that, even with a cruder sample prep, the DETECTR assay disclosed herein can identify target nucleic acids just as well as current industry standard PCR-based methods of detection.

Example 45

Cas13a Detection of DNA

This example describes Cas13a detection of DNA. Cas13a was used to detect RT-LAMP DNA amplicon from Influenza A RNA. FIG. 92A shows a schematic of the workflow including the steps of providing DNA or RNA, LAMP/RT-LAMP amplification, and Cas13a detection. The RT-LAMP reaction was performed at 55° C. for 30 minutes with a starting RNA concentration of 10,000 viral genome copies or 0 viral genome copies, as a control. Two different primer sets showed the same results (FIG. 92B and FIG. 92C). After completion of the RT-LAMP reaction, 1 µL of amplicon was added to a 20 µL Cas13a detection reaction. On-target and off-target crRNAs were used to show specific detection by Cas13a at 37° C. of the RT-LAMP DNA amplicon.

FIG. 92A shows a schematic of the workflow which includes providing DNA/RNA, LAMP/RT-LAMP amplification, and Cas13a detection. FIG. 92B shows Cas13a specific detection of RT-LAMP DNA amplicon with a first primer set as measured by background subtracted fluorescence on the y-axis. On-target crRNA results are shown by the darker bars and off-target crRNA control results are shown in lighter bars. A starting RNA concentration of 10,000 viral genome copies is shown in the left two bars and 0 viral genome copies (negative control) is shown in the right two bars. FIG. 92C shows Cas13a specific detection of RT-LAMP DNA amplicon with a second primer set as measured by background subtracted fluorescence on the y-axis. On-target crRNA results are shown by the darker bars and off-target crRNA control results are shown in lighter bars. A starting RNA concentration of 10,000 viral genome copies is shown in the left two bars and 0 viral genome copies (negative control) is shown in the right two bars.

Cas13a recognized ssDNA and RNA target nucleic acids. FIG. 93A shows a Cas13 detection assay using 2.5 nM RNA, single-stranded DNA (ssDNA), or double-stranded (dsDNA) as target nucleic acids, where detection was measured by fluorescence for each of the targets tested. The reaction was performed at 37° C. for 20 minutes with both RNA-FQ (RNA-fluorescence quenched reporter) and DNA-FQ reporter substrates. Results showed that Cas13 initiates trans-cleavage activity for RNA-FQ for both RNA and ssDNA targets. Data was normalized to max fluorescence signal for each reporter substrate. FIG. 93B shows Cas12 detection assay using 2.5 nM RNA, ssDNA, and dsDNA as target nucleic acids, where detection was measured by fluorescence for each of the targets tested. Reactions were performed at 37° C. for 20 minutes with both RNA-FQ and DNA-FQ reporter substrates. Results supported the previously established preference for Cas12 for either ssDNA or dsDNA targets and specificity for DNA-FQ. Data was normalized to max fluorescence signal for each reporter substrate. FIG. 93C shows the performance of Cas13 and Cas12 on RNA, ssDNA, and dsDNA targets at various concentrations, where detection was measured by fluorescence for each of the targets tested. Reactions were performed at 37° C. for 90 minutes with both RNA-FQ and DNA-FQ reporter substrates. Data was normalized to max fluorescence signal for each reporter substrate. Results indicated picomolar sensitivity of Cas13 for ssDNA.

Cas13a trans-cleavage activity was found to be specific for RNA when targeting ssDNA. FIG. 94 shows an Lbu-Cas13a detection assay using 2.5 nM ssDNA target with 170 nM of various reporter substrates, wherein detection was measured by fluorescence for each of the reporter substrates tested. A single RNA-FQ reporter substrate (rep01—FAM-U5) was tested and 13 DNA-FQ reporter substrates were tested. TABLE 12 below shows the sequence of each of the reporters tested.

TABLE 12

Reporter Sequences

| Reporter ID | SEQ ID NO: | Sequence |
|---|---|---|
| rep01 | 1 | /56-FAM/rUrUrUrUrU/3IABkFQ/ |
| rep08 | 171 | /56-FAM/AAAAA/3IABkFQ/ |
| rep09 | 172 | /56-FAM/CCCCC/3IABkFQ/ |
| rep10 | 173 | /56-FAM/GGGGG/3IABkFQ/ |
| rep11 | 174 | /56-FAM/TTTTT/3IABkFQ/ |
| rep12 | 175 | /56-FAM/TTATTA/3IABkFQ/ |
| rep13 | 9 | /56-FAM/TTATTATT/3IABkFQ/ |
| rep14 | 176 | /56-FAM/ATTATTATTA/3IABkFQ/ |
| rep15 | 10 | /56-FAM/TTTTTT/3IABkFQ/ |
| rep16 | 177 | /56-FAM/TTTTTTT/3IABkFQ/ |
| rep17 | 12 | /56-FAM/TTTTTTTTT/3IABkFQ/ |
| rep18 | 178 | /56-FAM/TTTTTTTTTT/3IABkFQ/ |
| rep19 | 13 | /56-FAM/TTTTTTTTTTT/3IABkFQ/ |
| rep30 | 179 | /FAM/CCGGCAGCCATAACGCCGTGAATACGTTCTGCCGG/BHQ1/ |

Results indicated that Cas13 trans-cleavage was RNA specific, even when activated by ssDNA.

Multiple Cas13 family members detected ssDNA target nucleic acids. FIG. 95A shows the results of Cas13 detection assays for Lbu-Cas13a and Lwa-Cas13a using 10 nM or 0 nM of RNA target, where detection was measured by fluorescence resulting from cleavage of reporters over time. Three RNA target sequences were evaluated with corresponding gRNAs. Results showed similar detection of all three target sequences for both Cas13 family members. FIG. 95B shows the results of Cas13 detection assays for Lbu- Cas13a and Lwa-Cas13a using 10 nM or 0 nM of ssDNA target, where detection was measured by fluorescence resulting from cleavage of reporters over time. Three DNA target sequences and their corresponding gRNAs, with the same sequence as the RNA targets, were evaluated. Results showed Cas13 family preferences in ssDNA target recognition, with Lbu-Cas13a exhibiting faster detection for some targets and Lwa-Cas13a exhibiting faster detection for other targets Cas13 detection of ssDNA was robust at multiple pH values. FIG. 96 shows Lbu-Cas13a detection assay using 1 nM RNA (at left) or ssDNA (at right) target in buffers with various pH values ranging from 6.8 to 8.2. Reactions were performed at 37° C. for 20 minutes with RNA-FQ reporter substrates. Results indicated enhanced Cas13 RNA detection at buffers with a higher pH (7.9 to 8.2), whereas Cas13 ssDNA detection was consistent across pH conditions (6.8 to 8.2).

Cas13 ssDNA targeting preferences were found to be distinct from RNA targeting preferences. FIG. 97A shows guide RNAs (gRNAs) tiled along a target sequence at 1 nucleotide intervals. FIG. 97B shows Cas13M26 detection assays using 0.1 nM RNA or 2 nM ssDNA target with gRNAs tiled at 1 nucleotide intervals and an off-target gRNA. Guide RNAs were ranked by their position along the target sequence. FIG. 97C shows data from FIG. 97B ranked by performance of ssDNA. Results showed that gRNA performance on ssDNA did not correlate with the performance of the same gRNAs on RNA. FIG. 97D shows performance of gRNAs on RNA split by the identity of the nucleotide on the target that is 3' of the target sequence. Results indicated that there are high performing gRNAs on RNAs regardless of target nucleotide identity at this position. FIG. 97E shows performance of gRNAs on RNA split by the identity of the nucleotide on the target that is 3' of the target sequence. Results indicated that a G in the target at this position performed worse than other gRNAs.

Cas13a detected DNA generated by nucleic acid amplification methods (PCR, LAMP). FIG. 98A shows Lbu-Cas13a detection assays using 1 µL of DNA amplicon from various LAMP isothermal nucleic acid amplification reactions. LAMP conditions tested included 6-primer with both loop-forward (LF) and loop-reverse (LB), asymmetric LAMP with LF only, and asymmetric LAMP with LB only. All tested LAMP reactions generated an Lbu-Cas13a compatible DNA target. FIG. 98B shows Cas13M26 detection assays using various amounts of PCR reaction as a DNA target. Results indicated that PCR generated enough ssDNA intermediates to enable Cas13 detection.

Example 46

Layouts and Workflows for Programmable Nuclease Systems

This example describes assay layouts and workflows for programmable nuclease systems. Here, DETECTR reactions are used in the programmable nuclease system. An assay is provided that comprises separate chambers for amplification and reverse transcription versus a programmable nuclease-based detection assay. The programmable nuclease is a Cas12, Cas13, or Cas14. The sample is a biofluid collected by a swab and inserted into a swab collection reservoir. A pump drives the fluidics in the assay moving sample from chamber to chamber. A detectable signal is colorimetric, fluorescence-based, electrochemical and/or generated using an enzyme (e.g., invertase).

FIG. 100A shows a schematic of a pneumatic valve device. A pipette pump aspirates and dispenses samples. An air manifold is connected to a pneumatic pump to open and close the normally closed valve. The pneumatic device moves fluid from one position to the next and isolates unused parts of the system. The pneumatic design has reduced channel cross talk compared to other devices. FIG. 100B shows a schematic of a cartridge for use in the pneumatic valve device. The normally closed valves (one such valve is indicated by an arrow) comprise an elastomeric seal on top of the channel to isolate each chamber from the rest of the system when the chamber is not in use. The pneumatic pump uses air to open and close the valve as needed to move fluid to the necessary chambers within the cartridge. The cartridge is able to incorporate multiple different sample media. The cartridge can accommodate lysis buffer volumes of 200 µL and perform incubation steps, for example, a 10 minute incubation. The cartridge accommodates aspiration of two 2 µL samples from up to four amplification chambers. The two samples can be dispensed into the corresponding detection chambers with limited cross contamination between amplification chambers or detection chambers. The cartridge accommodates transfer of 1-2 µL of lysed sample from the sample input chamber to an amplification chamber. The cartridge may comprise up to four amplification chambers, with two detection chambers per amplification chamber, for a total of up to eight detection chambers. Each DETECTR chamber may be imaged, for example by a spectrometer. As shown in FIG. 100 and illustrated in FIG. 101, the cartridge may have two amplification chambers and two detection chambers per amplification chamber.

FIG. 101 shows a valve circuitry layout for the pneumatic valve DETECTR device. The biofluid sample is placed in the sample well while all valves are closed, as shown at (i.). The sample is lysed in the sample well. The lysed sample is moved from the sample chamber to a second chamber by opening the first quake valve, as shown at (ii.), and aspirating the sample using the pipette pump. The sample is then moved to the first amplification chamber by closing the first quake valve and opening a second quake valve, as shown at (iii.) where it is mixed with the amplification mixture. After the sample is mixed with the amplification mixture, it is moved to a subsequent chamber by closing the second quake valve and opening a third quake valve, as shown at (iv). The sample is moved to the detection chamber by closing the quick third valve and opening a quick fourth valve, as shown at (v). The detection chamber comprises the programmable nuclease. If a target nucleic acid is present in the sample, a detectable signal may be produced. The detectable signal may be imaged in the detection chamber. The sample can be moved through a different series of chambers by opening and closing a different series of quake valves, as shown at (vi). Actuation of individual valves in the desired chamber series prevents cross contamination between channels.

FIG. 106 shows a schematic of the top layer of a cartridge of a pneumatic valve device of the present disclosure, highlighting suitable dimensions. The schematic shows one cartridge that is 2 inches by 1.5 inches. FIG. 107 shows a schematic of a modified top layer of a cartridge of a pneumatic valve device of the present disclosure adapted for electrochemical dimension. In this schematic, three lines are shown in the detection chambers (4 chambers at the very right). These three lines represent wiring (or "metal leads"), which is co-molded, 3D-printed, or manually assembled in the disposable cartridge to form a three-electrode system. Electrodes are termed as working, counter, and reference.

Example 47 dsDNA Enrichment for Type V Programmable Nuclease SNP DETECTR Reactions

This example describes dsDNA enrichment for type V programmable nuclease SNP DETECTR reactions. Type V programmable nucleases, for example Cas12, typically have high specificity for detection of SNPs in dsDNA substrates. Amplification, for example using PCR, allele-specific PCR, or isothermal amplification, can generate both ssDNA and dsDNA substrates, which may reduce the degree of specificity achieved by the Cas12 programmable nuclease for SNPs. Removal of ssDNA products changes specificity for SNP detection by type V programmable nucleases, for example Cas12 programmable nucleases.

FIG. 104 illustrates a method to enrich for dsDNA products following amplification. The method involves treating the reaction with a ssDNase with 3' to 5' exonuclease activity that is inhibited by phosphorothiate. The ssDNas may be an Exonuclease I, including both wild type *E. coli* and thermolabile exonucleases; Exonuclease III, including *E. coli* exonucleases; Exonuclease T; and RecJf. A target nucleic acid is amplified using PCR, allele-specific PCR, or isothermal amplification. The amplification process results in a mixture of dsDNA and ssDNA products. A ssDNase 3' to 5' exonuclease I, exonuclease III, exonuclease T, or RecJf is added to the amplified target nucleic acid sample. The ssDNase degrades ssDNA, leaving only dsDNA products. The presence of a SNP of interest in the target dsDNA is then detected using a type V SNP DETECTR reaction. To enable one-pot reactions, fully phosphorothioated primers and reporters may be incorporated.

Example 48

Determination of the Maximum Volume of LAMP Amplicon in a Cas12M08 DETECTR Reaction Before Assay Inhibition This example describes the determination of the maximum volume of LAMP amplicon that may be used in a Cas12M08 DETECTR reaction before the assay is inhibited. A concentrated complexing reaction (40 nM R778 crRNA, 40 nM Cas12M08 in MBuffer 3) was prepared at incubated at 37° C. for 30 minutes. The concentrated complexing reaction (2.5 µL) was combined with rep33 reporter substrate (0.02 µL of 100 nM reporter substrate). LAMP amplicon product solutions were prepared by combining different volumes of LAMP product with buffer (MBuffer3) to a total volume of 17.5 µL. Buffer was combined with 0 µL, 2 µL, 4 µL, 6 µL, 8 µL, 10 µL, 12 µL, or 14 µL of LAMP product. Buffer solutions containing different volumes of LAMP amplicon product were added to individual wells (17.5 µL) of an assay plate. Concentrated Cas12a complexing reaction with reporter substrate (2.5 µL) was added to each well containing the 17.5 µL of LAMP amplicon product. The assay plate was sealed, and the plate was shaken to mix. The fluorescence of each well was then read on a plate reader.

FIG. 105 shows the raw fluorescence produced in each well containing a Cas12a complexing reaction with different volumes of LAMP amplicon product. A higher fluorescence value is indicative of better assay performance. Addition of 2 µL of LAMP amplicon per DETECTR reaction showed the best assay performance (highest fluorescence) of any of the conditions tested. Increasing volumes of LAMP amplicon resulted in a decreasing assay performance, as measured by fluorescence.

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (181 sequences)

SEQ ID NO: 1 - RNA, 5 nt, Artificial Sequence
  source: /note="Description of Artificial Sequence: Synthetic oligonucleotide"
uuuuu

SEQ ID NO: 2 - RNA, 8 nt, Artificial Sequence
  source: /note="Description of Artificial Sequence: Synthetic oligonucleotide"
uuuuuuuu

SEQ ID NO: 3 - RNA, 10 nt, Artificial Sequence
  source: /note="Description of Artificial Sequence: Synthetic oligonucleotide"
uuuuuuuuuu

SEQ ID NO: 4 - DNA, 10 bp, Artificial Sequence
  source: /note="Description of Artificial Sequence: Synthetic oligonucleotide"
  source: /note="Description of Combined DNA/RNA Molecule: Synthetic oligonucleotide"
ttttuutttt

SEQ ID NO: 5 - DNA, 6 bp, Artificial Sequence
  source: /note="Description of Artificial Sequence: Synthetic oligonucleotide"
  source: /note="Description of Combined DNA/RNA Molecule: Synthetic oligonucleotide"
ttuutt

SEQ ID NO: 6 - DNA, 6 bp, Artificial Sequence
  source: /note="Description of Artificial Sequence: Synthetic oligonucleotide"
  source: /note="Description of Combined DNA/RNA Molecule: Synthetic oligonucleotide"
taaugc

SEQ ID NO: 7 - DNA, 6 bp, Artificial Sequence
  source: /note="Description of Artificial Sequence: Synthetic oligonucleotide"
  source: /note="Description of Combined DNA/RNA Molecule: Synthetic oligonucleotide"
tauggc

SEQ ID NO: 8 - RNA, 5 nt, Artificial Sequence
  source: /note="Description of Artificial Sequence: Synthetic oligonucleotide"
uuuuu

SEQ ID NO: 9 - DNA, 8 bp, Artificial Sequence
  source: /note="Description of Artificial Sequence: Synthetic oligonucleotide"
ttattatt

SEQ ID NO: 10 - DNA, 6 bp, Artificial Sequence
  source: /note="Description of Artificial Sequence: Synthetic oligonucleotide"
tttttt

SEQ ID NO: 11 - DNA, 8 bp, Artificial Sequence
  source: /note="Description of Artificial Sequence: Synthetic oligonucleotide"
tttttttt

SEQ ID NO: 12 - DNA, 10 bp, Artificial Sequence
  source: /note="Description of Artificial Sequence: Synthetic oligonucleotide"
tttttttttt

SEQ ID NO: 13 - DNA, 12 bp, Artificial Sequence
  source: /note="Description of Artificial Sequence: Synthetic oligonucleotide"
tttttttttttt

SEQ ID NO: 14 - DNA, 14 bp, Artificial Sequence
  source: /note="Description of Artificial Sequence: Synthetic oligonucleotide"
tttttttttttttt

SEQ ID NO: 15 - DNA, 6 bp, Artificial Sequence
  source: /note="Description of Artificial Sequence: Synthetic oligonucleotide"
aaaaaa

SEQ ID NO: 16 - DNA, 6 bp, Artificial Sequence
  source: /note="Description of Artificial Sequence: Synthetic oligonucleotide"
cccccc

SEQ ID NO: 17 - DNA, 6 bp, Artificial Sequence
  source: /note="Description of Artificial Sequence: Synthetic oligonucleotide"
gggggg

SEQ ID NO: 18 - DNA, 41 bp, Artificial Sequence
  source: /note="Description of Artificial Sequence: Synthetic oligonucleotide"
  source: /note="Description of Combined DNA/RNA Molecule: Synthetic oligonucleotide"
uaauuucuacuaaguguagauccggagcttggaacagactc

SEQ ID NO: 19 - RNA, 41 nt, Artificial Sequence
  source: /note="Description of Artificial Sequence: Synthetic oligonucleotide"
uaauuucuacuaaguguagauaagcuucgcuuguagaugag

SEQ ID NO: 20 - RNA, 41 nt, Artificial Sequence
  source: /note="Description of Artificial Sequence: Synthetic oligonucleotide"
uaauuucuacuaaguguagauacuugcaugcuuaagacgca

SEQ ID NO: 21 - RNA, 41 nt, Artificial Sequence
  source: /note="Description of Artificial Sequence: Synthetic oligonucleotide"
uaauuucuacuaaguguagauauccuggcuuagaacuaacg

SEQ ID NO: 22 - RNA, 41 nt, Artificial Sequence
  source: /note="Description of Artificial Sequence: Synthetic oligonucleotide"
uaauuucuacuaaguguagauauucgaugauacgcgaggaa

SEQ ID NO: 23 - RNA, 41 nt, Artificial Sequence
  source: /note="Description of Artificial Sequence: Synthetic oligonucleotide"
uaauuucuacuaaguguagaucaacauagguccacaguuga

SEQ ID NO: 24 - RNA, 41 nt, Artificial Sequence
  source: /note="Description of Artificial Sequence: Synthetic oligonucleotide"
uaauuucuacuaaguguagaucaacauaguuccacaguuga

SEQ ID NO: 25 - RNA, 41 nt, Artificial Sequence
  source: /note="Description of Artificial Sequence: Synthetic oligonucleotide"
uaauuucuacuaaguguagaucagcauaguuccacaguuga

SEQ ID NO: 26 - RNA, 41 nt, Artificial Sequence
  source: /note="Description of Artificial Sequence: Synthetic oligonucleotide"
uaauuucuacuaaguguagaucagcguacacuaccagggua

SEQ ID NO: 27 - RNA, 41 nt, Artificial Sequence
  source: /note="Description of Artificial Sequence: Synthetic oligonucleotide"
uaauuucuacuaaguguagaucccuaccaacuagcuaauaa

SEQ ID NO: 28 - RNA, 41 nt, Artificial Sequence
  source: /note="Description of Artificial Sequence: Synthetic oligonucleotide"
uaauuucuacuaaguguagaucuacaaagcuuauuccucau

SEQ ID NO: 29 - RNA, 41 nt, Artificial Sequence
  source: /note="Description of Artificial Sequence: Synthetic oligonucleotide"
uaauuucuacuaaguguagaugggucuauauacaggugcug

SEQ ID NO: 30 - RNA, 41 nt, Artificial Sequence
  source: /note="Description of Artificial Sequence: Synthetic oligonucleotide"
uaauuucuacuaaguguagaugggucuguauacaggugcug

SEQ ID NO: 31 - RNA, 41 nt, Artificial Sequence
  source: /note="Description of Artificial Sequence: Synthetic oligonucleotide"
uaauuucuacuaaguguagaugugacucagcgucagucuug

SEQ ID NO: 32 - RNA, 41 nt, Artificial Sequence
  source: /note="Description of Artificial Sequence: Synthetic oligonucleotide"
uaauuucuacuaaguguagauguuaacaccaagugugcauc

SEQ ID NO: 33 - RNA, 41 nt, Artificial Sequence
  source: /note="Description of Artificial Sequence: Synthetic oligonucleotide"
uaauuucuacuaaguguagauuaggaaaugacaaagcgaug

SEQ ID NO: 34 - RNA, 41 nt, Artificial Sequence
  source: /note="Description of Artificial Sequence: Synthetic oligonucleotide"
uaauuucuacuaaguguagauucauuuccuacaaagcuuau

SEQ ID NO: 35 - RNA, 41 nt, Artificial Sequence
  source: /note="Description of Artificial Sequence: Synthetic oligonucleotide"
uaauuucuacuaaguguagauugcauagacuuauauauccg

SEQ ID NO: 36 - RNA, 41 nt, Artificial Sequence
  source: /note="Description of Artificial Sequence: Synthetic oligonucleotide"
uaauuucuacuaaguguagauagguauguuuagugaggggg

SEQ ID NO: 37 - RNA, 41 nt, Artificial Sequence
  source: /note="Description of Artificial Sequence: Synthetic oligonucleotide"
uaauuucuacuaaguguagaugugaggggggugaagucgua

SEQ ID NO: 38 - RNA, 50 nt, Artificial Sequence
  source: /note="Description of Artificial Sequence: Synthetic oligonucleotide"
gccaccccaaaaaugaaggggacuaaaacauccuacaaaaaaaugcuaaa

SEQ ID NO: 39 - RNA, 50 nt, Artificial Sequence
  source: /note="Description of Artificial Sequence: Synthetic oligonucleotide"
gccaccccaaaaaugaaggggacuaaaacaccuacaaaaaaaugcuaaaa

SEQ ID NO: 40 - RNA, 50 nt, Artificial Sequence
  source: /note="Description of Artificial Sequence: Synthetic oligonucleotide"
gccaccccaaaaaugaaggggacuaaaacacuacaaaaaaaugcuaaaag

SEQ ID NO: 41 - RNA, 50 nt, Artificial Sequence
  source: /note="Description of Artificial Sequence: Synthetic oligonucleotide"
gccaccccaaaaaugaaggggacuaaaacaagaaacauuugauaacaaug

SEQ ID NO: 42 - RNA, 50 nt, Artificial Sequence
  source: /note="Description of Artificial Sequence: Synthetic oligonucleotide"
gccaccccaaaaaugaaggggacuaaaacagaaacauuugauaacaauga

SEQ ID NO: 43 - RNA, 50 nt, Artificial Sequence
  source: /note="Description of Artificial Sequence: Synthetic oligonucleotide"
gccaccccaaaaaugaaggggacuaaaacaaacauuugauaacaaugaag

SEQ ID NO: 44 - RNA, 50 nt, Artificial Sequence
  source: /note="Description of Artificial Sequence: Synthetic oligonucleotide"
gccaccccaaaaaugaaggggacuaaaacaacauuugauaacaaugaaga

SEQ ID NO: 45 - RNA, 50 nt, Artificial Sequence
  source: /note="Description of Artificial Sequence: Synthetic oligonucleotide"
gccaccccaaaaaugaaggggacuaaaacaugccuauaacaaaugaucag

SEQ ID NO: 46 - RNA, 50 nt, Artificial Sequence
  source: /note="Description of Artificial Sequence: Synthetic oligonucleotide"
gccaccccaaaaaugaaggggacuaaaacagccuauaacaaaugaucaga

SEQ ID NO: 47 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 48 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 49 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 50 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 51 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 52 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 53 - protein, 500 aa, Artificial Sequence
  source: /note="Description of Artificial Sequence: Synthetic polypeptide"
MEVQKTVMKTLSLRILRPLYSQEIEKEIKEEKERRKQAGGTGELDGGFYKKLEKKHSEMFSFDRLNLLLNQLQREIAKVYNHAISELYIATIAQGNKSNKHYISSIVYNRAYGYFYNAYIALGICSKVEANFRSNELLTQQSALPTAKSDNFPIVLHKQKGAEGEDGGFRISTEGSDLIFEIPIPFYEYNGENRKEPYKWVKKGGQKPVLKLILSTFRRQRNKGWAKDEGTDAEIRKVTEGKYQVSQIEINRGKKLGEHQKWFANFSIEQPIYERKPNRSIVGGLDVGIRSPLVCAINNSFSRYSVDSNDVFKFSKQVFAFRRRLLSKNSLKRKGHGAAHKLEPITEMTEKNDKFRKKIIERWAKEVTNFFVKNQVGIVQIEDLSTMKDREDHFFNQYLRGFWPYYQMQTLIENKLKEYGIEVKRVQAKYTSQLCSNPNCRYWNNYFNFEYRKVNKFPKFKCEKCNLEISADYNAARNLSTPDIEKFVAKATKGINLPEK

SEQ ID NO: 54 - protein, 507 aa, Artificial Sequence
  source: /note="Description of Artificial Sequence: Synthetic polypeptide"
MEEAKTVSKTLSLRILRPLYSAEIEKEIKEEKERRKQGGKSGELDSGFYKKLEKKHTQMFGWDKLNLMLSQLQRQIARVFNQSISELYIETVIQGKKSNKHYTSKIVYNRAYSVFYNAYLALGITSKVEANFRSTELLMQKSSLPTAKSDNFPILLHKQKGVEGEEGGFKISADGNDLIFEIPIPFYEYDSANKKEPFKWIKKGGQKPTIKLILSTFRRQRNKGWAKDEGTDAEIRKVIEGKYQVSHIEINRGKKLGDHQKWFVNFTIEQPIYERKLDKNIIGGIDVGIKSPLVCAVNNSFARYSVDSNDVLKFSKQAFAFRRRLLSKNSLKRSGHGSKNKLDPITRMTEKNDRFRKKIIERWAKEVTNFFIKNQVGTVQIEDLSTMKDRQDNFFNQYLRGFWPYYQMQNLIENKLKEYGIETKRIKARYTSQLCSNPSCRHWNSYFSFDHRKTNNFPKFKCEKCALEISADYNAARNISTPDIEKFVAKATKGINLPDKNENVILE

SEQ ID NO: 55 - protein, 529 aa, Artificial Sequence
  source: /note="Description of Artificial Sequence: Synthetic polypeptide"
MAKNTITKTLKLRIVRPYNSAEVEKIVADEKNNREKIALEKNKDKVKEACSKHLKVAAYCTTQVERNACLFCKARKLDDKFYQKLRGQFPDAVFWQEISEIFRQLQKQAAEIYNQSLIELYYEIFIKGKGIANASSVEHYLSDVCYTRAAELFKNAAIASGLRSKIKSNFRLKELKNMKSGLPTTKSDNFPIPLVKQKGGQYTGFEISNHNSDFIIKIPFGRWQVKKEIDKYRPWEKFDFEQVQKSPKPISLLLSTQRRKRNKGWSKDEGTEAEIKKVMNGDYQTSYIEVKRGSKIGEKSAWMLNLSIDVPKIDKGVDPSIIGGIDVGVKSPLVCAINNAFSRYSISDNDLFHFNKKMFARRRILLKKNRHKRAGHGAKNKLKPITILTEKSERFRKKLIERWACEIADFFIKNKVGTVQMENLESMKRKEDSYFNIRLRGFWPYAEMQNKIEFKLKQYGIEIRKVAPNNTSKTCSKCGHLNNYFNFEYRKKNKFPHFKCEKCNFKENADYNAALNISNPKLKSTKEEP

SEQ ID NO: 56 - protein, 726 aa, Artificial Sequence
  source: /note="Description of Artificial Sequence: Synthetic polypeptide"
MERQKVPQIRKIVRVVPLRILRPKYSDVIENALKKFKEKGDDTNTNDFWRAIRDRDTEFFRKELNFSEDEINQLERDTLFRVGLDNRVLFSYFDFLQEKLMKDYNKIISKLFINRQSKSSFENDLTDEEVEELIEKDVTPFYGAYIGKGIKSVIKSNLGGKFIKSVKIDRETKKVTKLTAINIGLMGLPVAKSDTFPIKIIKTNPDYITFQKSTKENLQKIEDYETGIEYGDLLVQITIPWFKNENKDFSLIKTKEAIEYYKLNGVGKKDLLNINLVLTTYHIRKKKSWQIDGSSQSLVREMANGELEEKWKSFFDTFIKKYGDEGKSALVKRRVNKKSRAKGEKGRELNLDERIKRLYDSIKAKSFPSEINLIPENYKWKLHFSIEIPPMVNDIDSNLYGGIDFGEQNIATLCVKNIEKDDYDFLTIYGNDLLKHAQASYARRRIMRVQDEYKARGHGKSRKTKAQEDYSERMQKLRQKITERLVKQISDFFLWRNKFHMAVCSLRYEDLNTLYKGESVKAKRMRQFINKQQLFNGIERKLKDYNSEIYVNSRYPHYTSRLCSKCGKLNLYFDFLKFRTKNIIIRKNPDGSEIKYMPFFICEFCGWKQAGDKNASANIADKDYQDKLNKEKEFCNIRKPKSKKEDIGEENEEERDYSRRFNRNSFIYNSLKKDNKLNQEKLFDEWKNQLKRKIDGRNKFEPKEYKDRFSYLFAYYQEIIKNESES

SEQ ID NO: 57 - protein, 517 aa, Artificial Sequence
  source: /note="Description of Artificial Sequence: Synthetic polypeptide"
MVPTELITKTLQLRVIRPLYFEEIEKELAELKEQKEKEFEETNSLLLESKKIDAKSLKKLKRKARSSAAVEFWKIAKEKYPDILTKPEMEFIFSEMQKMMARFYNKSMTNIFIEMNNDEKVNPLSLISKASTEANQVIKCSSISSGLNRKIAGSINKTKFKQVRDGLISLPTARTETFPISFYKSTANKDEIPISKINLPSEEEADLTITLPFPFFEIKKEKKGQKAYSYFNIIEKSGRSNNKIDLLLSTHRRQRRKGWKEEGGTSAEIRRLMEGEFDKEWEIYLGEAEKSEKAKNDLIKNMTRGKLSKDIKEQLEDIQVKYFSDNNVESWNDLSKEQKQELSKLRKKKVEELKDWKHVKEILKTRAKIGWVELKRGKRQRDRNKWFVNITITRPPFINKELDDTKFGGIDLGVKVPFVCAVHGSPARLIIKENEILQFNKMVSARNRQITKDSEQRKGRGKKNKFIKKEIFNERNELFRKKIIERWANQIVKFFEDQKCATVQIENLESFDRTSYK

SEQ ID NO: 58 - protein, 481 aa, Artificial Sequence
  source: /note="Description of Artificial Sequence: Synthetic polypeptide"
MKSDTKDKKIIIHQTKTLSLRIVKPQSIPMEEFTDLVRYHQMIIFPVYNNGAIDLYKKLFKAKIQKGNEARAIKYFMNKIVYAPIANTVKNSYIALGYSTKMQSSFSGKRLWDLRFGEATPPTIKADFPLPFYNQSGFKVSSENGEFIIGIPFGQYTKKTVSDIEKKTSFAWDKFTLEDTTKKTLIELLLSTKTRKMNEGWKNNEGTEAEIKRVMDGTYQVTSLEILQRDDSWFVNFNIAYDSLKKQPDRDKIAGIHMGITRPLTAVIYNNKYRALSIYPNTVMHLTQKQLARIKEQRTNSKYATGGHGRNAKVTGTDTLSEAYRQRRKKIIEDWIASIVKFAINNEIGTIYLEDISNTNSFFAAREQKLIYLEDISNTNSFLSTYKYPISAISDTLQHKLEEKAIQVIRKKAYYVNQICSLCGHYNKGFTYQFRRKNKFPKMKCQGCLEATSTEFNAAANVANPDYEKLLIKHGLLQLKK

SEQ ID NO: 59 - protein, 358 aa, Artificial Sequence
  source: /note="Description of Artificial Sequence: Synthetic polypeptide"
MSTITRQVRLSPTPEQSRLLMAHCQQYISTVNVLVAAFDSEVLTGKVSTKDFRAALPSAVKNQALRDAQSVFKRSVELGCLPVLKKPHCQWNNQNWRVEGDQLILPICKDGKTQQERFRCAAVALEGKAGILRIKKKRGKWIADLTVTQEDAPESSGSAIMGVDLGIKVPAVAHIGGKGTRFFGNGRSQRSMRRRFYARRKTLQKAKKLRAVRKSKGKEARWMKTINHQLSRQIVNHAHALGVGTIKIEALQGIRKGTTRKSRGAAARKNNRMTNTWSFSQLTLFITYKAQRQGITVEQVDPAYTSQDCPACRARNGAQDRTYVCSECGWRGHRDTVGAINISRRAGLSGHRRGATGA

SEQ ID NO: 60 - protein, 507 aa, Artificial Sequence
  source: /note="Description of Artificial Sequence: Synthetic polypeptide"
MIAQKTIKIKLNPTKEQIIKLNSIIEEYIKVSNFTAKKIAEIQESFTDSGLTQGTCSECGKEKTYRKYHLLKKDNKLFCITCYKRKYSQFTLQKVEFQNKTGLRNVAKLPKTYYTNAIRFASDTFSGFDEIIKKKQNRLNSIQNRLNFWKELLYNPSNRNEIKIKVVKYAPKTDTREHPHYYSEAEIKGRIKRLEKQLKKFKMPKYPEFTSETISLQRELYSWKNPDELKISSITDKNESMNYYGKEYLKRYIDLINSQTPQILLEKENNSFYLCFPITKNIEMPKIDDTFEPVGIDWGITRNIAVVSILDSKTKKPKFVKFYSAGYILGKRKHYKSLRKHFGQKKRQDKINKLGTKEDRFIDSNIHKLAFLIVKEIRNHSNKPIILMENITDNREEAEKSMRQNILLHSVKSRLQNYIAYKALWNNIPTNLVKPEHTSQICNRCGHQDRENRPKGSKLFKCVKCNYMSNADFNASINIARKFYIGEYEPFYKDNEKMKSGVNSISM

SEQ ID NO: 61 - protein, 534 aa, Artificial Sequence
  source: /note="Description of Artificial Sequence: Synthetic polypeptide"
LKLSEQENITTGVKFKLKLDKETSEGLNDYFDEYGKAINFAIKVIQKELAEDRFAGKVRLDENKKPLLNEDGKKIWDFPNEFCSCGKQVNRYVNGKSLCQECYKNKFTEYGIRKRMYSAKGRKAEQDINIKNSTNKISKTHFNYAIREAFILDKSIKKQRKERFRRLREMKKKLQEFIEIRDGNKILCPKIEKQRVERYIHPSWINKEKKLEDFRGYSMSNVLGKIKILDRNIKREEKSLKEKGQINFKARRLMLDKSVKFLNDNKISFTISKNLPKEYELDLPEKEKRLNWLKEKIKIIKNQKPKYAYLLRKDDNFYLQYTLETEFNLKEDYSGIVGIDRGVSHIAVYTFVHNNGKNERPLFLNSSEILRLKNLQKERDRFLRRKHNKKRKKSNMRNIEKKIQLILHNYSKQIVDFAKNKNAFIVFEKLEKPKKNRSKMSKKSQYKLSQFTFKKLSDLVDYKAKREGIKVLYISPEYTSKECSHCGEKVNTQRPFNGNSSLFKCNKCGVELNADYNASINIAKKGLNILNSTN

SEQ ID NO: 62 - protein, 537 aa, Artificial Sequence
  source: /note="Description of Artificial Sequence: Synthetic polypeptide"
MEESIITGVKFKLRIDKETTKKLNEYFDEYGKAINFAVKIIQKELADDRFAGKAKLDQNKNPILDENGKKIYEFPDEFCSCGKQVNKYVNNKPFCQECYKIRFTENGIRKRMYSAKGRKAEHKINILNSTNKISKTHFNYAIREAFILDKSIKKQRKKRNERLRESKKRLQQFIDMRDGKREICPTIKGQKVDRFIHPSWITKDKKLEDFRGYTLSIINSKIKILDRNIKREEKSLKEKGQIIFKAKRLMLDKSIRFVGDRKVLFTISKTLPKEYELDLPSKEKRLNWLKEKIEIIKNQKPKYAYLLRKNIESEKKPNYEYYLQYTLEIKPELKDFYDGAIGIDRGINHIAVCTFISNDGKVTPPKFFSSGEILRLKNLQKERDRFLLRKHNKNRKKGNMRVIENKINLILHRYSKQIVDMAKKLNASIVFEELGRIGKSRTKMKKSQRYKLSLFIFKKLSDLVDYKSRREGIRVTYVPPEYTSKECSHCGEKVNTQRPFNGNYSLFKCNKCGIQLNSDYNASINIAKKGLKIPNST

SEQ ID NO: 63 - protein, 540 aa, Artificial Sequence
  source: /note="Description of Artificial Sequence: Synthetic polypeptide"
LWTIVIGDFIEMPKQDLVTTGIKFKLDVDKETRKKLDDYFDEYGKAINFAVKIIQKNLKEDRFAGKIALGEDKKPLLDKDGKKIYNYPNESCSCGNQVRRYVNAKPFCVDCYKLKFTENGIRKRMYSARGRKADSDINIKNSTNKISKTHFNYAIREGFILDKSLKKQRSKRIKKLLELKRKLQEFIDIRQGQMVLCPKIKNQRVDKFIHPSWLKRDKKLEEFRGYSLSVVEGKIKIFNRNILREEDSLRQRGHVNFKANRIMLDKSVRFLDGGKVNFNLNKGLPKEYLLDLPKKENKLSWLNEKISLIKLQKPKYAYLLRREGSFFIQYTIENVPKTFSDYLGAIGIDRGISHIAVCTFVSKNGVNKAPVFFSSGEILKLKSLQKQRDLFLRGKHNKIRKKSNMRNIDNKINLILHKYSRNIVNLAKSEKAFIVFEKLEKIKKSRFKMSKSLQYKLSQFTFKKLSDLVEYKAKIEGIKVDYVPPEYTSKECSHCGEKVDTQRPFNGNSSLFKCNKCRVQLNADYNASINIAKKSLNISN

SEQ ID NO: 64 - protein, 542 aa, Artificial Sequence
  source: /note="Description of Artificial Sequence: Synthetic polypeptide"
MSKTTISVKLKIIDLSSEKKEFLDNYFNEYAKATTFCQLRIRRLLRNTHWLGKKEKSSKKWIFESGICDLCGENKELVNEDRNSGEPAKICKRCYNGRYGNQMIRKLFVSTKKREVQENMDIRRVAKLNNTHYHRIPEEAFDMIKAADTAEKRRKKNVEYDKKRQMEFIEMFNDEKKRAARPKKPNERETRYVHISKLESPSKGYTLNGIKRKIDGMGKKIERAEKGLSRKKIFGYQGNRIKLDSNWVRFDLAESEITIPSLFKEMKLRITGPTNVHSKSGQIYFAEWFERINKQPNNYCYLIRKTSSNGKYEYYLQYTYEAEVEANKEYAGCLGVDIGCSKLAAAVYYDSKNKKAQKPIEIFTNPIKKIKMRREKLIKLLSRVKVRHRRRKLMQLSKTEPIIDYTCHKTARKIVEMANTAKAFISMENLETGIKQKQQARETKKQKFYRNMFLFRKLSKLIEYKALLKGIKIVYVKPDYTSQTCSSCGADKEKTERPSQAIFRCLNPTCRYYQRDINADFNAAVNIAKKALNNTEVVTTLL

SEQ ID NO: 65 - protein, 564 aa, Artificial Sequence
  source: /note="Description of Artificial Sequence: Synthetic polypeptide"
MARAKNQPYQKLTTTTGIKFKLDLSEEEGKRFDEYFSEYAKAVNFCAKVIYQLRKNLKFAGKKELAAKEWKFEISNCDFCNKQKEIYYKNIANGQKVCKGCHRTNFSDNAIRKKMIPVKGRKVESKFNIHNTTKKISGTHRHWAFEDAADIIESMDKQRKEKQKRLRREKRKLSYFFELFGDPAKRYELPKVGKQRVPRYLHKIIDKDSLTKKRGYSLSYIKNKIKISERNIERDEKSLRKASPIAFGARKIKMSKLDPKRAFDLENNVFKIPGKVIKGQYKFFGTNVANEHGKKFYKDRISKILAGKPKYFYLLRKKVAESDGNPIFEYYVQWSIDTETPAITSYDNILGIDAGITNLATTVLIPKNLSAEHCSHCGNNHVKPIFTKFFSGKELKAIKIKSRKQKYFLRGKHNKLVKIKRIRPIEQKVDGYCHVVSKQIVEMAKERNSCIALEKLEKPKKSKFRQRRREKYAVSMFVFKKLATFIKYKAAREGIEIIPVEPEGTSYTCSHCKNAQNNQRPYFKPNSKKSWTSMFKCGKCGIELNSDYNAAFNIAQKALNMTSA

SEQ ID NO: 66 - protein, 610 aa, Artificial Sequence
  source: /note="Description of Artificial Sequence: Synthetic polypeptide"
MDEKHFFCSYCNKELKISKNLINKISKGSIREDEAVSKAISIHNKKEHSLILGIKFKLFIENKLDKKKLNEYFDNYSKAVTFAARIFDKIRSPYKFIGLKDKNTKKWTFPKAKCVFCLEEKEVAYANEKDNSKICTECYLKEFGENGIRKKIYSTRGRKVEPKYNIFNSTKELSSTHYNYAIRDAFQLLDALKKQRQKKLKSIFNQKLRLKEFEDIFSDPQKRIELSLKPHQREKRYIHLSKSGQESINRGYTLRFVRGKIKSLTRNIEREEKSLRKKTPIHFKGNRLMIFPAGIKFDFASNKVKISISKNLPNEFNFSGTNVKNEHGKSFFKSRIELIKTQKPKYAYVLRKIKREYSKLRNYEIEKIRLENPNADLCDFYLQYTIETESRNNEEINGIIGIDRGITNLACLVLLKKGDKKPSGVKFYKGNKILGMKIAYRKHLYLLKGKRNKLRKQRQIRAIEPKINLILHQISKDIVKIAKEKNFAIALEQLEKPKKARFAQRKKEKYKLALFTFKNLSTLIEYKSKREGIPVIYVPPEKTSQMCSHCAINGDEHVDTQRPYKKPNAQKPSYSLFKCNKCGIELNADYNAAFNIAQKGLKTLMLNHSH

SEQ ID NO: 67 - protein, 369 aa, Artificial Sequence
  source: /note="Description of Artificial Sequence: Synthetic polypeptide"
MLQTLLVKLDPSKEQYKMLYETMERFNEACNQIAETVFAIHSANKIEVQKTVYYPIREKFGLSAQLTILAIRKVCEAYKRDKSIKPEFRLDGALVYDQRVLSWKGLDKVSLVTLQGRQIIPIKFGDYQKARMDRIRGQADLILVKGVFYLCVVVEVSEESPYDPKGVLGVDLGIKNLAVDSDGEVHSGEQTTNTRERLDSLKARLQSKGTKSAKRHLKKLSGRMAKFSKDVNHCISKKLVAKAKGTLMSIALEDLQGIRDRVTVRKAQRRNLHTWNFGLLRMFVDYKAKIAGVPLVFVDPRNTSRTCPSCGHVAKANRPTRDEFRCVSCGFAGAADHIAAMNIAFRAEVSQPIVTRFFVQSQAPSFRVG

SEQ ID NO: 68 - protein, 552 aa, Artificial Sequence
  source: /note="Description of Artificial Sequence: Synthetic polypeptide"
MDEEPDSAEPNLAPISVKLKLVKLDGEKLAALNDYFNEYAKAVNFCELKMQKIRKNLVNIRGTYLKEKKAWINQTGECCICKKIDELRCEDKNPDINGKICKKCYNGRYGNQMIRKLFVSTNKRAVPKSLDIRKVARLHNTHYHRIPPEAADIIKAIETAERKRRNRILFDERRYNELKDALENEEKRVARPKKPKEREVRYVPISKKDTPSKGYTMNALVRKVSGMAKKIERAKRNLNKRKKIEYLGRRILLDKNWVRFDFDKSEISIPTMKEFFGEMRFEITGPSNVMSPNGREYFTKWFDRIKAQPDNYCYLLRKESEDETDFYLQYTWRPDAHPKKDYTGCLGIDIGGSKLASAVYFDADKNRAKQPIQIFSNPIGKWKTKRQKVIKVLSKAAVRHKTKKLESLRNIEPRIDVHCHRIARKIVGMALAANAFISMENLEGGIREKQKAKETKKQKFSRNMFVFRKLSKLIEYKALMEGVKVVYIVPDYTSQLCSSCGTNNTKRPKQAIFMCQNTECRYFGKNINADFNAAINIAKKALNRKDIVRELS

SEQ ID NO: 69 - protein, 534 aa, Artificial Sequence
  source: /note="Description of Artificial Sequence: Synthetic polypeptide"
MEKNNSEQTSITTGIKFKLKLDKETKEKLNNYFDEYGKAINFAVRIIQMQLNDDRLAGKYKRDEKGKPILGEDGKKILEIPNDFCSCGNQVNHYVNGVSFCQECYKKRFSENGIRKRMYSAKGRKAEQDINIKNSTNKISKTHFNYAIREAFNLDKSIKKQREKRFKKLKDMKRKLQEFLEIRDGKRVICPKIEKQKVERYIHPSWINKEKKLEEFRGYSLSIVNSKIKSFDRNIQREEKSLKEKGQINFKAQRLMLDKSVKFLKDNKVSFTISKELPKTFELDLPKKEKKLNWLNEKLEIIKNQKPKYAYLLRKENNIFLQYTLDSIPEIHSEYSGAVGIDRGVSHIAVYTFLDKDGKNERPFFLSSSGILRLKNLQKERDKFLRKKHNKIRKKGNMRNIEQKINLILHEYSKQIVNFAKDKNAFIVFELLEKPKKSRERMSKKIQYKLSQFTFKKLSDLVDYKAKREGIKVIYVEPAYTSKDCSHCGERVNTQRPFNGNFSLFKCNKCGIVLNSDYNASLNIARKGLNISAN

SEQ ID NO: 70 - protein, 577 aa, Artificial Sequence
  source: /note="Description of Artificial Sequence: Synthetic polypeptide"
MAEEKFFFCEKCNKDIKIPKNYINKQGAEEKARAKHEHRVHALILGIKFKIYPKKEDISKLNDYFDEYAKAVTFTAKIVDKLKAPFLFAGKRDKDTSKKKWVFPVDKCSFCKEKTEINYRTKQGKNICNSCYLTEFGEQGLLEKIYATKGRKVSSSFNLFNSTKKLTGTHNNYVVKESLQLLDALKKQRSKRLKKLSNTRRKLKQFEEMFEKEDKRFQLPLKEKQRELRFIHVSQKDRATEFKGYTMNKIKSKIKVLRRNIEREQRSLNRKSPVFFRGTRIRLSPSVQFDDKDNKIKLTLSKELPKEYSFSGLNVANEHGRKFFAEKLKLIKENKSKYAYLLRRQVNKNNKKPIYDYYLQYTVEFLPNIITNYNGILGIDRGINTLACIVLLENKKEKPSFVKFFSGKGILNLKNKRRKQLYFLKGVHNKYRKQQKIRPIEPRIDQILHDISKQIIDLAKEKRVAISLEQLEKPQKPKFRQSRKAKYKLSQFNFKTLSNYIDYKAKKEGIRVIYIAPEMTSQNCSRCAMKNDLHVNTQRPYKNTSSLFKCNKCGVELNADYNAAFNIAQKGLKILNS

SEQ ID NO: 71 - protein, 613 aa, Artificial Sequence
  source: /note="Description of Artificial Sequence: Synthetic polypeptide"
MISLKLKLLPDEEQKKLLDEMFWKWASICTRVGFGRADKEDLKPPKDAEGVWFSLTQLNQANTDINDLREAMKHQKHRLEYEKNRLEAQRDDTQDALKNPDRREISTKRKDLFRPKASVEKGFLKLKYHQERYWVRRLKEINKLIERKTKTLIKIEKGRIKFKATRITLHQGSFKIRFGDKPAFLIKALSGKNQIDAPFVVVPEQPICGSVVNSKKYLDEITTNFLAYSVNAMLFGLSRSEEMLLKAKRPEKIKKKEEKLAKKQSAFENKKKELQKLLGRELTQQEEAIIEETRNQFFQDFEVKITKQYSELLSKIANELKQKNDFLKVNKYPILLRKPLKKAKSKKINNLSPSEWKYYLQFGVKPLLKQKSRRKSRNVLGIDRGLKHLLAVTVLEPDKKTFVWNKLYPNPITGWKWRRRKLLRSLKRLKRRIKSQKHETIHENQTRKKLKSLQGRIDDLLHNISRKIVETAKEYDAVIVVEDLQSMRQHGRSKGNRLKTLNYALSLFDYANVMQLIKYKAGIEGIQIYDVKPAGTSQNCAYCLLAQRDSHEYKRSQENSKIGVCLNPNCQNHKKQIDADLNAARVIASCYALKINDSQPFGTRKRFKKRTTN

SEQ ID NO: 72 - protein, 615 aa, Artificial Sequence
  source: /note="Description of Artificial Sequence: Synthetic polypeptide"
METLSLKLKLNPSKEQLLVLDKMFWKWASICTRLGLKKAEMSDLEPPKDAEGVWFSKTQLNQANTDVNDLRKAMQHQGKRIEYELDKVENRRNEIQEMLEKPDRRDISPNRKDLFRPKAAVEKGYLKLKYHKLGYWSKELKTANKLIERKRKTLAKIDAGKMKFKPTRISLHTNSFRIKFGEEPKIALSTTSKHEKIELPLITSLQRPLKTSCAKKSKTYLDAAILNFLAYSTNAALFGLSRSEEMLLKAKKPEKIEKRDRKLATKRESFDKKLKTLEKLLERKLSEKEKSVFKRKQTEFFDKFCITLDETYVEALHRIAEELVSKNKYLEIKKYPVLLRKPESRLRSKKLKNLKPEDWTYYIQFGFQPLLDTPKPIKTKTVLGIDRGVRHLLAVSIFDPRTKTFTFNRLYSNPIVDWKWRRRKLLRSIKRLKRRLKSEKHVHLHENQFKAKLRSLEGRIEDHFHNLSKEIVDLAKENNSVIVVENLGGMRQHGRGRGKWLKALNYALSHFDYAKVMQLIKYKAELAGVFVYDVAPAGTSINCAYCLLNDKDASNYTRGKVINGKKNTKIGECKTCKKEFDADLNAARVIALCYEKRLNDPQPFGTRKQFKPKKP

SEQ ID NO: 73 - protein, 775 aa, Artificial Sequence
  source: /note="Description of Artificial Sequence: Synthetic polypeptide"
MKALKLQLIPTRKQYKILDEMFWKWASLANRVSQKGESKETLAPKKDIQKIQFNATQLNQIEKDIKDLRGAMKEQQKQKERLLLQIQERRSTISEMLNDDNNKERDPHRPLNFRPKGWRKFHTSKHWVGELSKILRQEDRVKKTIERIVAGKISFKPKRIGIWSSNYKINFFKRKISINPLNSKGFELTLMTEPTQDLIGKNGGKSVLNNKRYLDDSIKSLLMFALHSRFFGLNNTDTYLLGGKINPSLVKYYKKNQDMGEFGREIVEKFERKLKQEINEQQKKIIMSQIKEQYSNRDSAFNKDYLGLINEFSEVFNQRKSERAEYLLDSFEDKIKQIKQEIGESLNISDWDFLIDEAKKAYGYEEGFTEYVYSKRYLEILNKIVKAVLITDIYFDLRKYPILLRKPLDKIKKISNLKPDEWSYYIQFGYDSINPVQLMSTDKFLGIDRGLTHLLAYSVFDKEKKEFIINQLEPNPIMGWKWKLRKVKRSLQHLERRIRAQKMVKLPENQMKKKLKSIEPKIEVHYHNISRKIVNLAKDYNASIVVESLEGGGLKQHGRKKNARNRSLNYALSLFDYGKIASLIKYKADLEGVPMYEVLPAYTSQQCAKCVLEKGSFVDPEIIGYVEDIGIKGSLLDSLFEGTELSSIQVLKKIKNKIELSARDNHNKEINLILKYNFKGLVIVRGQDKEEIAEHPIKEINGKFAILDFVYKRGKEKVGKKGNQKVRYTGNKKVGYCSKHGQVDADLNASRVIALCKYLDINDPILFGEQRKSFK

SEQ ID NO: 74 - protein, 777 aa, Artificial Sequence
  source: /note="Description of Artificial Sequence: Synthetic polypeptide"
MVTRAIKLKLDPTKNQYKLLNEMFWKWASLANRFSQKGASKETLAPKDGTQKIQFNATQLNQIKKDVDDLRGAMEKQGKQKERLLIQIQERLLTISEILRDDSKKEKDPHRPQNFRPFGWRRFHTSAYWSSEASKLTRQVDRVRRTIERIKAGKINFKPKRIGLWSSTYKINFLKKKINISPLKSKSFELDLITEPQQKIIGKEGGKSVANSKKYLDDSIKSLLIFAIKSRLFGLNNKDKPLFENIITPNLVRYHKKGQEQENFKKEVIKKFENKLKKEISQKQKEIIFSQIERQYENRDATFSEDYLRAISEFSEIFNQRKKERAKELLNSFNEKIRQLKKEVNGNISEEDLKILEVEAEKAYNYENGFIEWEYSEQFLGVLEKIARAVLISDNYFDLKKYPILIRKPTNKSKKITNLKPEEWDYYIQFGYGLINSPMKIETKNFMGIDRGLTHLLAYSIFDRDSEKFTINQLELNPIKGWKWKLRKVKRSLQHLERRMRAQKGVKLPENQMKKRLKSIEPKIESYYHNLSRKIVNLAKANNASIVVESLEGGGLKQHGRKKNSRHRALNYALSLFDYGKIASLIKYKSDLEGVPMYEVLPAYTSQQCAKCVLKKGSFVEPEIIGYIEEIGFKENLLTLLFEDTGLSSVQVLKKSKNKMTLSARDKEGKMVDLVLKYNFKGLVISQEKKKEEIVEFPIKEIDGKFAVLDSAYKRGKERISKKGNQKLVYTGNKKVGYCSVHGQVDADLNASRVIALCKYLGINEPIVFGEQRKSFK

SEQ ID NO: 75 - protein, 610 aa, Artificial Sequence
  source: /note="Description of Artificial Sequence: Synthetic polypeptide"
LDLITEPIQPHKSSSLRSKEFLEYQISDFLNFSLHSLFFGLASNEGPLVDFKIYDKIVIPKPEERFPKKESEEGKKLDSFDKRVEEYYSDKLEKKIERKLNTEEKNVIDREKTRIWGEVNKLEEIRSIIDEINEIKKQKHISEKSKLLGEKWKKVNNIQETLLSQEYVSLISNLSDELTNKKKELLAKKYSKFDDKIKKIKEDYGLEFDENTIKKEGEKAFLNPDKFSKYQFSSSYLKLIGEIARSLITYKGFLDLNKYPIIFRKPINKVKKIHNLEPDEWKYYIQFGYEQINNPKLETENILGIDRGLTHILAYSVFEPRSSKFILNKLEPNPIEGWKWKLRKLRRSIQNLERRWRAQDNVKLPENQMKKNLRSIEDKVENLYHNLSRKIVDLAKEKNACIVFEKLEGQGMKQHGRKKSDRLRGLNYKLSLFDYGKIAKLIKYKAEIEGIPIYRIDSAYTSQNCAKCVLESRRFAQPEEISCLDDFKEGDNLDKRILEGTGLVEAKIYKKLLKEKKEDFEIEEDIAMFDTKKVIKENKEKTVILDYVYTRRKEIIGTNHKKNIKGIAKYTGNTKIGYCMKHGQVDADLNASRTIALCKNFDINNPEIWK

SEQ ID NO: 76 - protein, 632 aa, Artificial Sequence
  source: /note="Description of Artificial Sequence: Synthetic polypeptide"
MSDESLVSSEDKLAIKIKIVPNAEQAKMLDEMFKKWSSICNRISRGKEDIETLRPDEGKELQFNSTQLNSATMDVSDLKKAMARQGERLEAEVSKLRGRYETIDASLRDPSRRHTNPQKPSSFYPSDWDISGRLTPRFHTARHYSTELRKLKAKEDKMLKTINKIKNGKIVFKPKRITLWPSSVNMAFKGSRLLLKPFANGFEMELPIVISPQKTADGKSQKASAEYMRNALLGLAGYSINQLLFGMNRSQKMLANAKKPEKVEKFLEQMKNKDANFDKKIKALEGKWLLDRKLKESEKSSIAVVRTKFFKSGKVELNEDYLKLLKHMANEILERDGFVNLNKYPILSRKPMKRYKQKNIDNLKPNMWKYYIQFGYEPIFERKASGKPKNIMGIDRGLTHLLAVAVFSPDQQKFLFNHLESNPIMHWKWKLRKIRRSIQHMERRIRAEKNKHIHEAQLKKRLGSIEEKTEQHYHIVSSKIINWAIEYEAAIVLESLSHMKQRGGKKSVRTRALNYALSLFDYEKVARLITYKARIRGIPVYDVLPGMTSKTCATCLLNGSQGAYVRGLETTKAAGKATKRKNMKIGKCMVCNSSENSMIDADLNAARVIAICKYKNLNDPQPAGSRKVFKRF

SEQ ID NO: 77 - protein, 625 aa, Artificial Sequence
  source: /note="Description of Artificial Sequence: Synthetic polypeptide"
MLALKLKIMPTEKQAEILDAMFWKWASICSRIAKMKKKVSVKENKKELSKKIPSNSDIWFSKTQLCQAEVDVGDHKKALKNFEKRQESLLDELKYKVKAINEVINDESKREIDPNNPSKFRIKDSTKKGNLNSPKFFTLKKWQKILQENEKRIKKKESTIEKLKRGNIFFNPTKISLHEEEYSINFGSSKLLLNCFYKYNKKSGINSDQLENKFNEFQNGLNIICSPLQPIRGSSKRSFEFIRNSIINFLMYSLYAKLFGIPRSVKALMKSNKDENKLKLEEKLKKKKSSFNKTVKEFEKMIGRKLSDNESKILNDESKKFFEIIKSNNKYIPSEEYLKLLKDISEEIYNSNIDFKPYKYSILIRKPLSKFKSKKLYNLKPTDYKYYLQLSYEPFSKQLIATKTILGIDRGLKHLLAVSVFDPSQNKFVYNKLIKNPVFKWKKRYHDLKRSIRNRERRIRALTGVHIHENQLIKKLKSMKNKINVLYHNVSKNIVDLAKKYESTIVLERLENLKQHGRSKGKRYKKLNYVLSNFDYKKIESLISYKAKKEGVPVSNINPKYTSKTCAKCLLEVNQLSELKNEYNRDSKNSKIGICNIHGQIDADLNAARVIALCYSKNLNEPHFK

SEQ ID NO: 78 - protein, 517 aa, Artificial Sequence
  source: /note="Description of Artificial Sequence: Synthetic polypeptide"
VINLFGYKFALYPNKTQEELLNKHLGECGWLYNKAIEQNEYYKADSNIEEAQKKFELLPDKNSDEAKVLRGNISKDNYVYRTLVKKKKSEINVQIRKAVVLRPAETIRNLAKVKKKGLSVGRLKFIPIREWDVLPFKQSDQIRLEENYLILEPYGRLKFKMHRPLLGKPKTFCIKRTATDRWTISFSTEYDDSNMRKNDGGQVGIDVGLKTHLRLSNENPDEDPRYPNPKIWKRYDRRLTILQRRISKSKKLGKNRTRLRLRLSRLWEKIRNSRADLIQNETYEILSENKLIAIEDLNVKGMQEKKDKKGRKGRTRAQEKGLHRSISDAAFSEFRRVLEYKAKRFGSEVKPVSAIDSSKECHNCGNKKGMPLESRIYECPKCGLKIDRDLNSAKVILARATGVRPGSNARADTKISATAGASVQTEGTVSEDFRQQMETSDQKPMQGEGSKEPPMNPEHKSSGRGSKHVNIGCKNKVGLYNEDENSRSTEKQIMDENRSTTEDMVEIGALHSPVLTT

SEQ ID NO: 79 - protein, 410 aa, Artificial Sequence
  source: /note="Description of Artificial Sequence: Synthetic polypeptide"
MIASIDYEAVSQALIVFEFKAKGKDSQYQAIDEAIRSYRFIRNSCLRYWMDNKKVGKYDLNKYCKVLAKQYPFANKLNSQARQSAAECSWSAISRFYDNCKRKVSGKKGFPKFKKHARSVEYKTSGWKLSENRKAITFTDKNGIGKLKLKGTYDLHFSQLEDMKRVRLVRRADGYYVQFCISVDVKVETEPTGKAIGLDVGIKYFLADSSGNTIENPQFYRKAEKKLNRANRRKSKKYIRGVKPQSKNYHKARCRYARKHLRVSRQRKEYCKRVAYCVIHSNDVVAYEDLNVKGMVKNRHLAKSISDVAWSTFRHWLEYFAIKYGKLTIPVAPHNTSQNCSNCDKKVPKSLSTRTHICHHCGYSEDRDVNAAKNILKKALSTVGQTGSLKLGEIEPLLVLEQSCTRKFDL

SEQ ID NO: 80 - protein, 486 aa, Artificial Sequence
  source: /note="Description of Artificial Sequence: Synthetic polypeptide"
LAEENTLHLTLAMSLPLNDLPENRTRSELWRRQWLPQKKLSLLLGVNQSVRKAAADCLRWFEPYQELLWWEPTDPDGKKLLDKEGRPIKRTAGHMRVLRKLEEIAPFRGYQLGSAVKNGLRHKVADLLLSYAKRKLDPQFTDKTSYPSIGDQFPIVWTGAFVCYEQSITGQLYLYLPLFPRGSHQEDITNNYDPDRGPALQVFGEKEIARLSRSTSGLLLPLQFDKWGEATFIRGENNPPTWKATHRRSDKKWLSEVLLREKDFQPKRVELLVRNGRIFVNVACEIPTKPLLEVENFMGVSFGLEHLVTVVVINRDGNVVHQRQEPARRYEKTYFARLERLRRRGGPFSQELETFHYRQVAQIVEEALRFKSVPAVEQVGNIPKGRYNPRLNLRLSYWPFGKLADLTSYKAVKEGLPKPYSVYSATAKMLCSTCGAANKEGDQPISLKGPTVYCGNCGTRHNTGFNTALNLARRAQELFVKGVVAR

SEQ ID NO: 81 - protein, 602 aa, Artificial Sequence
  source: /note="Description of Artificial Sequence: Synthetic polypeptide"
MSQSLLKWHDMAGRDKDASRSLQKSAVEGVLLHLTASHRVALEMLEKSVSQTVAVTMEAAQQRLVIVLEDDPTKATSRKRVISADLQFTREEFGSLPNWAQKLASTCPEIATKYADKHINSIRIAWGVAKESTNGDAVEQKLQWQIRLLDVTMFLQQLVLQLADKALLEQIPSSIRGGIGQEVAQQVTSHIQLLDSGTVLKAELPTISDRNSELARKQWEDAIQTVCTYALPFSRERARILDPGKYAAEDPRGDRLINIDPMWARVLKGPTVKSLPLLFVSGSSIRIVKLTLPRKHAAGHKHTFTATYLVLPVSREWINSLPGTVQEKVQWWKKPDVLATQELLVGKGALKKSANTLVIPISAGKKRFFNHILPALQRGFPLQWQRIVGRSYRRPATHRKWFAQLTIGYTNPSSLPEMALGIHFGMKDILWWALADKQGNILKDGSIPGNSILDFSLQEKGKIERQQKAGKNVAGKKYGKSLLNATYRVVNGVLEFSKGISAEHASQPIGLGLETIRFVDKASGSSPVNARHSNWNYGQLSGIFANKAGPAGFSVTEITLKKAQRDLSDAEQARVLAIEATKRFASRIKRLATKRKDDTLFV

SEQ ID NO: 82 - protein, 494 aa, Artificial Sequence
  source: /note="Description of Artificial Sequence: Synthetic polypeptide"
VEPVEKERFYYRTYTFRLDGQPRTQNLTTQSGWGLLTKAVLDNTKHYWEIVHHARIANQPIVFENPVIDEQGNPKLNKLGQPRFWKRPISDIVNQLRALFENQNPYQLGSSLIQGTYWDVAENLASWYALNKEYLAGTATWGEPSFPEPHPLTEINQWMPLTFSSGKVVRLLKNASGRYFIGLPILGENNPCYRMRTIEKLIPCDGKGRVTSGSLILFPLVGIYAQQHRRMTDICESIRTEKGKLAWAQVSIDYVREVDKRRRMRRTRKSQGWIQGPWQEVFILRLVLAHKAPKLYKPRCFAGISLGPKTLASCVILDQDERVVEKQQWSGSELLSLIHQGEERLRSLREQSKPTWNAAYRKQLKSLINTQVFTIVTFLRERGAAVRLESIARVRKSTPAPPVNFLLSHWAYRQITERLKDLAIRNGMPLTHSNGSYGVRFTCSQCGATNQGIKDPTKYKVDIESETFLCSICSHREIAAVNTATNLAKQLLDE

SEQ ID NO: 83 - protein, 526 aa, Artificial Sequence
  source: /note="Description of Artificial Sequence: Synthetic polypeptide"
MNDTETSETLTSHRTVCAHLHVVGETGSLPRLVEAALAELITLNGRATQALLSLAKNGLVLRRDKEENLIAAELTLPCRKNKYADVAAKAGEPILATRINNKGKLVTKKWYGEGNSYHIVRFTPETGMFTVRVFDRYAFDEELLHLHSEVVFGSDLPKGIKAKTDSLPANFLQAVFTSFLELPFQGFPDIVVKPAMKQAAEQLLSYVQLEAGENQQAEYPDTNERDPELRLVEWQKSLHELSVRTEPFEFVRARDIDYYAETDRRGNRFVNITPEWTKFAESPFARRLPLKIPPEFCILLRRKTEGHAKIPNRIYLGLQIFDGVTPDSTLGVLATAEDGKLFWWHDHLDEFSNLEGKPEPKLKNKPQLLMVSLEYDREQRFEESVGGDRKICLVTLKETRNFRRGWNGRILGIHFQHNPVITWALMDHDAEVLEKGFIEGNAFLGKALDKQALNEYLQKGGKWVGDRSFGNKLKGITHTLASLIVRLAREKDAWIALEEISWVQKQSADSVANHEIVEQPHHSLTR

SEQ ID NO: 84 - protein, 649 aa, Artificial Sequence
  source: /note="Description of Artificial Sequence: Synthetic polypeptide"
MNDTETSETLTSHRTVCAHLHVVGETGSLPRLVEAALAELITLNGRATQALLSLAKNGLVLRRDKEENLIAAELTLPCRKNKYADVAAKAGEPILATRINNKGKLVTKKWYGEGNSYHIVRFTPETGMFTVRVFDRYAFDEELLHLHSEVVFGSDLPKGIKAKTDSLPANFLQAVFTSFLELPFQGFPDIVVKPAMKQAAEQLLSYVQLEAGENQQAEYPDTNERDPELRLVEWQKSLHELSVRTEPFEFVRARDIDYYAETDRRGNRFVNITPEWTKFAESPFARRLPLKIPPEFCILLRRKTEGHAKIPNRIYLGLQIFDGVTPDSTLGVLATAEDGKLFWWHDHLDEFSNLEGKPEPKLKNKPQLLMVSLEYDREQRFEESVGGDRKICLVTLKETRNFRRGRHGHTRTDRLPAGNTLWRADFATSAEVAAPKWNGRILGIHFQHNPVITWALMDHDAEVLEKGFIEGNAFLGKALDKQALNEYLQKGGKWVGDRSFGNKLKGITHTLASLIVRLAREKDAWIALEEISWVQKQSADSVANRRFSMWNYSRLATLIEWLGTDIATRDCGTAAPLAHKVSDYLTHFTCPECGACRKAGQKKEIADTVRAGDILTCRKCGFSGPIPDNFIAEFVAKKALERMLKKKPV

SEQ ID NO: 85 - protein, 414 aa, Artificial Sequence
  source: /note="Description of Artificial Sequence: Synthetic polypeptide"
MAKRNFGEKSEALYRAVRFEVRPSKEELSILLAVSEVLRMLFNSALAERQQVFTEFIASLYAELKSASVPEEISEIRKKLREAYKEHSISLFDQINALTARRVEDEAFASVTRNWQEETLDALDGAYKSFLSLRRKGDYDAHSPRSRDSGFFQKIPGRSGFKIGEGRIALSCGAGRKLSFPIPDYQQGRLAETTKLKKFELYRDQPNLAKSGRFWISVVYELPKPEATTCQSEQVAFVALGASSIGVVSQRGEEVIALWRSDKHWVPKIEAVEERMKRRVKGSRGWLRLLNSGKRRMHMISSRQHVQDEREIVDYLVRNHGSHFVVTELVVRSKEGKLADSSKPERGGSLGLNWAAQNTGSLSRLVRQLEEKVKEHGGSVRKHKLTLTEAPPARGAENKLWMARKLRESFLKEV

SEQ ID NO: 86 - protein, 413 aa, Artificial Sequence
  source: /note="Description of Artificial Sequence: Synthetic polypeptide"
LAKNDEKELLYQSVKFEIYPDESKIRVLTRVSNILVLVWNSALGERRARFELYIAPLYEELKKFPRKSAESNALRQKIREGYKEHIPTFFDQLKKLLTPMRKEDPALLGSVPRAYQEETLNTLNGSFVSFMTLRRNNDMDAKPPKGRAEDRFHEISGRSGFKIDGSEFVLSTKEQKLRFPIPNYQLEKLKEAKQIKKFTLYQSRDRRFWISIAYEIELPDQRPFNPEEVIYIAFGASSIGVISPEGEKVIDFWRPDKHWKPKIKEVENRMRSCKKGSRAWKKRAAARRKMYAMTQRQQKLNHREIVASLLRLGFHFVVTEYTVRSKPGKLADGSNPKRGGAPQGFNWSAQNTGSFGEFILWLKQKVKEQGGTVQTFRLVLGQSERPEKRGRDNKIEMVRLLREKYLESQTIVV

SEQ ID NO: 87 - protein, 449 aa, Artificial Sequence
  source: /note="Description of Artificial Sequence: Synthetic polypeptide"
MAKGKKKEGKPLYRAVRFEIFPTSDQITLFLRVSKNLQQVWNEAWQERQSCYEQFFGSIYERIGQAKKRAQEAGFSEVWENEAKKGLNKKLRQQEISMQLVSEKESLLQELSIAFQEHGVTLYDQINGLTARRIIGEFALIPRNWQEETLDSLDGSFKSFLALRKNGDPDAKPPRQRVSENSFYKIPGRSGFKVSNGQIYLSFGKIGQTLTSVIPEFQLKRLETAIKLKKFELCRDERDMAKPGRFWISVAYEIPKPEKVPVVSKQITYLAIGASRLGVVSPKGEFCLNLPRSDYHWKPQINALQERLEGVVKGSRKWKKRMAACTRMFAKLGHQQKQHGQYEVVKKLLRHGVHFVVTELKVRSKPGALADASKSDRKGSPTGPNWSAQNTGNIARLIQKLTDKASEHGGTVIKRNPPLLSLEERQLPDAQRKIFIAKKLREEFLADQK

SEQ ID NO: 88 - protein, 711 aa, Artificial Sequence
  source: /note="Description of Artificial Sequence: Synthetic polypeptide"
MAKREKKDDVVLRGTKMRIYPTDRQVTLMDMWRRRCISLWNLLLNLETAAYGAKNTRSKLGWRSIWARVVEENHAKALIVYQHGKCKKDGSFVLKRDGTVKHPPRERFPGDRKILLGLFDALRHTLDKGAKCKCNVNQPYALTRAWLDETGHGARTADIIAWLKDFKGECDCTAISTAAKYCPAPPTAELLTKIKRAAPADDLPVDQAILLDLFGALRGGLKQKECDHTHARTVAYFEKHELAGRAEDILAWLIAHGGTCDCKIVEEAANHCPGPRLFIWEHELAMIMARLKAEPRTEWIGDLPSHAAQTVVKDLVKALQTMLKERAKAAAGDESARKTGFPKFKKQAYAAGSVYFPNTTMFFDVAAGRVQLPNGCGSMRCEIPRQLVAELLERNLKPGLVIGAQLGLLGGRIWRQGDRWYLSCQWERPQPTLLPKTGRTAGVKIAASIVFTTYDNRGQTKEYPMPPADKKLTAVHLVAGKQNSRALEAQKEKEKKLKARKERLRLGKLEKGHDPNALKPLKRPRVRRSKLFYKSAARLAACEAIERDRRDGFLHRVTNEIVHKFDAVSVQKMSVAPMMRRQKQKEKQIESKKNEAKKEDNGAAKKPRNLKPVRKLLRHVAMARGRQFLEYKYNDLRGPGSVLIADRLEPEVQECSRCGTKNPQMKDGRRLLRCIGVLPDGTDCDAVLPRNRNAARNAEKRLRKHREAHNA

SEQ ID NO: 89 - protein, 574 aa, Artificial Sequence
  source: /note="Description of Artificial Sequence: Synthetic polypeptide"
MNEVLPIPAVGEDAADTIMRGSKMRIYPSVRQAATMDLWRRRCIQLWNLLLELEQAAYSGENRRTQIGWRSIWATVVEDSHAEAVRVAREGKKRKDGTFRKAPSGKEIPPLDPAMLAKIQRQMNGAVDVDPKTGEVTPAQPRLFMWEHELQKIMARLKQAPRTHWIDDLPSHAAQSVVKDLIKALQAMLRERKKRASGIGGRDTGFPKFKKNRYAAGSVYFANTQLRFEAKRGKAGDPDAVRGEFARVKLPNGVGWMECRMPRHINAAHAYAQATLMGGRIWRQGENWYLSCQWKMPKPAPLPRAGRTAAIKIAAAIPITTVDNRGQTREYAMPPIDRERIAAHAAAGRAQSRALEARKRRAKKREAYAKKRHAKKLERGIAAKPPGRARIKLSPGFYAAAAKLAKLEAEDANAREAWLHEITTQIVRNFDVIAVPRMEVAKLMKKPEPPEEKEEQVKAPWQGKRRSLKAARVMMRRTAMALIQTTLKYKAVDLRGPQAYEEIAPLDVTAAACSGCGVLKPEWKMARAKGREIMRCQEPLPGGKTCNTVLTYTRNSARVIGRELAVRLAERQKA

SEQ ID NO: 90 - protein, 400 aa, Artificial Sequence
  source: /note="Description of Artificial Sequence: Synthetic polypeptide"
MTTQKTYNFCFYDQRFFELSKEAGEVYSRSLEEFWKIYDETGVWLSKFDLQKHMRNKLERKLLHSDSFLGAMQQVHANLASWKQAKKVVPDACPPRKPKFLQAILFKKSQIKYKNGFLRLTLGTEKEFLYLKWDINIPLPIYGSVTYSKTRGWKINLCLETEVEQKNLSENKYLSIDLGVKRVATIFDGENTITLSGKKFMGLMHYRNKLNGKTQSRLSHKKKGSNNYKKIQRAKRKTTDRLLNIQKEMLHKYSSFIVNYAIRNDIGNIIIGDNSSTHDSPNMRGKTNQKISQNPEQKLKNYIKYKFESISGRVDIVPEPYTSRKCPHCKNIKKSSPKGRTYKCKKCGFIFDRDGVGAINIYNENVSFGQIISPGRIRSLTEPIGMKFHNEIYFKSYVAA

SEQ ID NO: 91 - protein, 743 aa, Artificial Sequence
  source: /note="Description of Artificial Sequence: Synthetic polypeptide"
MSVRSFQARVECDKQTMEHLWRTHKVFNERLPEIIKILFKMKRGECGQNDKQKSLYKSISQSILEANAQNADYLLNSVSIKGWKPGTAKKYRNASFTWADDAAKLSSQGIHVYDKKQVLGDLPGMMSQMVCRQSVEAISGHIELTKKWEKEHNEWLKEKEKWESEDEHKKYLDLREKFEQFEQSIGGKITKRRGRWHLYLKWLSDNPDFAAWRGNKAVINPLSEKAQIRINKAKPNKKNSVERDEFFKANPEMKALDNLHGYYERNFVRRRKTKKNPDGFDHKPTFTLPHPTIHPRWFVFNKPKTNPEGYRKLILPKKAGDLGSLEMRLLTGEKNKGNYPDDWISVKFKADPRLSLIRPVKGRRVVRKGKEQGQTKETDSYEFFDKHLKKWRPAKLSGVKLIFPDKTPKAAYLYFTCDIPDEPLTETAKKIQWLETGDVTKKGKKRKKKVLPHGLVSCAVDLSMRRGTTGFATLCRYENGKIHILRSRNLWVGYKEGKGCHPYRWTEGPDLGHIAKHKREIRILRSKRGKPVKGEESHIDLQKHIDYMGEDRFKKAARTIVNFALNTENAASKNGFYPRADVLLLENLEGLIPDAEKERGINRALAGWNRRHLVERVIEMAKDAGFKRRVFEIPPYGTSQVCSKCGALGRRYSIIRENNRREIRFGYVEKLFACPNCGYCANADHNASVNLNRRFLIEDSFKSYYDWKRLSEKKQKEEIETIESKLMDKLCAMHKISRGSISK

SEQ ID NO: 92 - protein, 769 aa, Artificial Sequence
  source: /note="Description of Artificial Sequence: Synthetic polypeptide"
MHLWRTHCVFNQRLPALLKRLFAMRRGEVGGNEAQRQVYQRVAQFVLARDAKDSVDLLNAVSLRKRSANSAFKKKATISCNGQAREVTGEEVFAEAVALASKGVFAYDKDDMRAGLPDSLFQPLTRDAVACMRSHEELVATWKKEYREWRDRKSEWEAEPEHALYLNLRPKFEEGEAARGGRFRKRAERDHAYLDWLEANPQLAAWRRKAPPAVVPIDEAGKRRIARAKAWKQASVRAEEFWKRNPELHALHKIHVQYLREFVRPRRTRRNKRREGFKQRPTFTMPDPVRHPRWCLFNAPQTSPQGYRLLRLPQSRRTVGSVELRLLTGPSDGAGFPDAWVNVRFKADPRLAQLRPVKVPRTVTRGKNKGAKVEADGFRYYDDQLLIERDAQVSGVKLLFRDIRMAPFADKPIEDRLLSATPYLVFAVEIKDEARTERAKAIRFDETSELTKSGKKRKTLPAGLVSVAVDLDTRGVGFLTRAVIGVPEIQQTHHGVRLLQSRYVAVGQVEARASGEAEWSPGPDLAHIARHKREIRRLRQLRGKPVKGERSHVRLQAHIDRMGEDRFKKAARKIVNEALRGSNPAAGDPYTRADVLLYESLETLLPDAERERGINRALLRWNRAKLIEHLKRMCDDAGIRHFPVSPFGTSQVCSKCGALGRRYSLARENGRAVIRFGWVERLFACPNPECPGRRPDRPDRPFTCNSDHNASVNLHRVFALGDQAVAAFRALAPRDSPARTLAVKRVEDTLRPQLMRVHKLADAGVDSPF

SEQ ID NO: 93 - protein, 666 aa, Artificial Sequence
  source: /note="Description of Artificial Sequence: Synthetic polypeptide"
MATLVYRYGVRAHGSARQQDAVVSDPAMLEQLRLGHELRNALVGVQHRYEDGKRAVWSGFASVAAADHRVTTGETAVAELEKQARAEHSADRTAATRQGTAESLKAARAAVKQARADRKAAMAAVAEQAKPKIQALGDDRDAEIKDLYRRFCQDGVLLPRCGRCAGDLRSDGDCTDCGAAHEPRKLYWATYNAIREDHQTAVKLVEAKRKAGQPARLRFRRWTGDGTLTVQLQRMHGPACRCVTCAEKLTRRARKTDPQAPAVAADPAYPPTDPPRDPALLASGQGKWRNVLQLGTWIPPGEWSAMSRAERRRVGRSHIGWQLGGGRQLTLPVQLHRQMPADADVAMAQLTRVRVGGRHRMSVALTAKLPDPPQVQGLPPVALHLGWRQRPDGSLRVATWACPQPLDLPPAVADVVVSHGGRWGEVIMPARWLADAEVPPRLLGRRDKAMEPVLEALADWLEAHTEACTARMTPALVRRWRSQGRLAGLTNRWRGQPPTGSAEILTYLEAWRIQDKLLWERESHLRRRLAARRDDAWRRVASWLARHAGVLVVDDADIAELRRRDDPADTDPTMPASAAQAARARAALAAPGRLRHLATITATRDGLGVHTVASAGLTRLHRKCGHQAQPDPRYAASAVVTCPGCGNGYDQDYNAAMLMLDRQQQP

SEQ ID NO: 94 - protein, 564 aa, Artificial Sequence
  source: /note="Description of Artificial Sequence: Synthetic polypeptide"
MSRVELHRAYKFRLYPTPAQVAELAEWERQLRRLYNLAHSQRLAAMQRHVRPKSPGVLKSECLSCGAVAVAEIGTDGKAKKTVKHAVGCSVLECRSCGGSPDAEGRTAHTAACSFVDYYRQGREMTQLLEEDDQLARVVCSARQETLRDLEKAWQRWHKMPGFGKPHFKKRIDSCRIYFSTPKSWAVDLGYLSFTGVASSVGRIKIRQDRVWPGDAKFSSCHVVRDVDEWYAVFPLTFTKEIEKPKGGAVGINRGAVHAIADSTGRVVDSPKFYARSLGVIRHRARLLDRKVPFGRAVKPSPTKYHGLPKADIDAAAARVNASPGRLVYEARARGSIAAAEAHLAALVLPAPRQTSQLPSEGRNRERARRFLALAHQRVRRQREWFLHNESAHYAQSYTKIAIEDWSTKEMTSSEPRDAEEMKRVTRARNRSILDVGWYELGRQIAYKSEATGAEFAKVDPGLRETETHVPEAIVRERDVDVSGMLRGEAGISGTCSRCGGLLRASASGHADAECEVCLHVEVGDVNAAVNVLKRAMFPGAAPPSKEKAKVTIGIKGRKKKRAA

SEQ ID NO: 95 - protein, 565 aa, Artificial Sequence
  source: /note="Description of Artificial Sequence: Synthetic polypeptide"
MSRVELHRAYKFRLYPTPVQVAELSEWERQLRRLYNLGHEQRLLTLTRHLRPKSPGVLKGECLSCDSTQVQEVGADGRPKTTVRHAEQCPTLACRSCGALRDAEGRTAHTVACAFVDYYRQGREMTELLAADDQLARVVCSARQEVLRDLDKAWQRWRKMPGFGKPRFKRRTDSCRIYFSTPKAWKLEGGHLSFTGAATTVGAIKMRQDRNWPASVQFSSCHVVRDVDEWYAVFPLTFVAEVARPKGGAVGINRGAVHAIADSTGRVVDSPRYYARALGVIRHRARLFDRKVPSGHAVKPSPTKYRGLSAIEVDRVARATGFTPGRVVTEALNRGGVAYAECALAAIAVLGHGPERPLTSDGRNREKARKFLALAHQRVRRQREWFLHNESAHYARTYSKIAIEDWSTKEMTASEPQGEETRRVTRSRNRSILDVGWYELGRQLAYKTEATGAEFAQVDPGLKETETNVPKAIADARDVDVSGMLRGEAGISGTCSKCGGLLRAPASGHADAECEICLNVEVGDVNAAVNVLKRAMFPGDAPPASGEKPKVSIGIKGRQKKKKAA

SEQ ID NO: 96 - protein, 499 aa, Artificial Sequence
  source: /note="Description of Artificial Sequence: Synthetic polypeptide"
MEAIATGMSPERRVELGILPGSVELKRAYKFRLYPMKVQQAELSEWERQLRRLYNLAHEQRLAALLRYRDWDFQKGACPSCRVAVPGVHTAACDHVDYFRQAREMTQLLEVDAQLSRVICCARQEVLRDLDKAWQRWRKKLGGRPRFKRRTDSCRIYLSTPKHWEIAGRYLRLSGLASSVGEIRIEQDRAFPEGALLSSCSIVRDVDEWYACLPLTFTQPIERAPHRSVGLNRGVVHALADSDGRVVDSPKFFERALATVQKRSRDLARKVSGSRNAHKARIKLAKAHQRVRRQRAAFLHQESAYYSKGFDLVALEDMSVRKMTATAGEAPEMGRGAQRDLNRGILDVGWYELARQIDYKRLAHGGELLRVDPGQTTPLACVTEEQPARGISSACAVCGIPLARPASGNARMRCTACGSSQVGDVNAAENVLTRALSSAPSGPKSPKASIKIKGRQKRLGTPANRAGEASGGDPPVRGPVEGGTLAYVVEPVSESQSDT

SEQ ID NO: 97 - protein, 560 aa, Artificial Sequence
  source: /note="Description of Artificial Sequence: Synthetic polypeptide"
MTVRTYKYRAYPTPEQAEALTSWLRFASQLYNAALEHRKNAWGRHDAHGRGFRFWDGDAAPRKKSDPPGRWVYRGGGGAHISKNDQGKLLTEFRREHAELLPPGMPALVQHEVLARLERSMAAFFQRATKGQKAGYPRWRSEHRYDSLTFGLTSPSKERFDPETGESLGRGKTVGAGTYHNGDLRLTGLGELRILEHRRIPMGAIPKSVIVRRSGKRWFVSIAMEMPSVEPAASGRPAVGLDMGVVTWGTAFTADTSAAAALVADLRRMATDPSDCRRLEELEREAAQLSEVLAHCRARGLDPARPRRCPKELTKLYRRSLHRLGELDRACARIRRRLQAAHDIAEPVPDEAGSAVLIEGSNAGMRHARRVARTQRRVARRTRAGHAHSNRRKKAVQAYARAKERERSARGDHRHKVSRALVRQFEEISVEALDIKQLTVAPEHNPDPQPDLPAHVQRRRNRGELDAAWGAFFAALDYKAADAGGRVARKPAPHTTQECARCGTLVPKPISLRVHRCPACGYTAPRTVNSARNVLQRPLEEPGRAGPSGANGRGVPHAVA

SEQ ID NO: 98 - protein, 404 aa, Artificial Sequence
  source: /note="Description of Artificial Sequence: Synthetic polypeptide"
MNCRYRYRIYPTPGQRQSLARLFGCVRVVWNDALFLCRQSEKLPKNSELQKLCITQAKKTEARGWLGQVSAIPLQQSVADLGVAFKNFFQSRSGKRKGKKVNPPRVKRRNNRQGARFTRGGFKVKTSKVYLARIGDIKIKWSRPLPSEPSSVTVIKDCAGQYFLSFVVEVKPEIKPPKNPSIGIDLGLKTFASCSNGEKIDSPDYSRLYRKLKRCQRRLAKRQRGSKRRERMRVKVAKLNAQIRDKRKDFLHKLSTKVVNENQVIALEDLNVGGMLKNRKLSRAISQAGWYEFRSLCEGKAEKHNRDFRVISRWEPTSQVCSECGYRWGKIDLSVRSIVCINCGVEHDRDDNASVNIEQAGLKVGVGHTHDSKRTGSACKTSNGAVCVEPSTHREYVQLTLFDW

SEQ ID NO: 99 - protein, 392 aa, Artificial Sequence
  source: /note="Description of Artificial Sequence: Synthetic polypeptide"
MKSRWTFRCYPTPEQEQHLARTFGCVRFVWNWALRARTDAFRAGERIGYPATDKALTLLKQQPETVWLNEVSSVCLQQALRDLQVAFSNFFDKRAAHPSFKRKEARQSANYTERGFSFDHERRILKLAKIGAIKVKWSRKAIPHPSSIRLIRTASGKYFVSLVVETQPAPMPETGESVGVDFGVARLATLSNGERISNPKHGAKWQRRLAFYQKRLARATKGSKRRMRIKRHVARIHEKIGNSRSDTLHKLSTDLVTRFDLICVEDLNLRGMVKNHSLARSLHDASIGSAIRMIEEKAERYGKNVVKIDRWFPSSKTCSDCGHIVEQLPLNVREWTCPECGTTHDRDANAAANILAVGQTVSAHGGTVRRSRAKASERKSQRSANRQGVNRA

SEQ ID NO: 100 - protein, 500 aa, Artificial Sequence
  source: /note="Description of Artificial Sequence: Synthetic polypeptide"
KEPLNIGKTAKAVFKEIDPTSLNRAANYDASIELNCKECKFKPFKNVKRYEFNFYNNWYRCNPNSCLQSTYKAQVRKVEIGYEKLKNEILTQMQYYPWFGRLYQNFFHDERDKMTSLDEIQVIGVQNKVFFNTVEKAWREIIKKRFKDNKETMETIPELKHAAGHGKRKLSNKSLLRRRFAFVQKSFKFVDNSDVSYRSFSNNIACVLPSRIGVDLGGVISRNPKREYIPQEISFNAFWKQHEGLKKGRNIEIQSVQYKGETVKRIEADTGEDKAWGKNRQRRFTSLILKLVPKQGGKKVWKYPEKRNEGNYEYFPIPIEFILDSGETSIRFGGDEGEAGKQKHLVIPFNDSKATPLASQQTLLENSRFNAEVKSCIGLAIYANYFYGYARNYVISSIYHKNSKNGQAITAIYLESIAHNYVKAIERQLQNLLLNLRDFSFMESHKKELKKYFGGDLEGTGGAQKRREKEEKIEKEIEQSYLPRLIRLSLTKMVTKQVEM

SEQ ID NO: 101 - protein, 507 aa, Artificial Sequence
  source: /note="Description of Artificial Sequence: Synthetic polypeptide"
ELIVNENKDPLNIGKTAKAVFKEIDPTSINRAANYDASIELACKECKFKPFNNTKRHDFSFYSNWHRCSPNSCLQSTYRAKIRKTEIGYEKLKNEILNQMQYYPWFGRLYQNFFNDQRDKMTSLDEIQVTGVQNKIFFNTVEKAWREIIKKRFRDNKETMRTIPDLKNKSGHGSRKLSNKSLLRRRFAFAQKSFKLVDNSDVSYRAFSNNVACVLPSKIGVDIGGIINKDLKREYIPQEITFNVFWKQHDGLKKGRNIEIHSVQYKGEIVKRIEADTGEDKAWGKNRQRRFTSLILKITPKQGGKKIWKFPEKKNASDYEYFPIPIEFILDNGDASIKFGGEEGEVGKQKHLLIPFNDSKATPLSSKQMLLETSRFNAEVKSTIGLALYANYFVSYARNYVIKSTYHKNSKKGQIVTEIYLESISQNFVRAIQRQLQSLMLNLKDWGFMQTHKKELKKYFGSDLEGSKGGQKRREKEEKIEKEIEASYLPRLIRLSLTKSVTKAEEM

SEQ ID NO: 102 - protein, 529 aa, Artificial Sequence
  source: /note="Description of Artificial Sequence: Synthetic polypeptide"
PEEKTSKLKPNSINLAANYDANEKFNCKECKFHPFKNKKRYEFNFYNNLHGCKSCTKSTNNPAVKRIEIGYQKLKFEIKNQMEAYPWFGRLRINFYSDEKRKMSELNEMQVTGVKNKIFFDAIECAWREILKKRFRESKETLITIPKLKNKAGHGARKHRNKKLLIRRRAFMKKNFHFLDNDSISYRSFANNIACVLPSKVGVDIGGIISPDVGKDIKPVDISLNLMWASKEGIKSGRKVEIYSTQYDGNMVKKIEAETGEDKSWGKNRKRRQTSLLLSIPKPSKQVQEFDFKEWPRYKDIEKKVQWRGFPIKIIFDSNHNSIEFGTYQGGKQKVLPIPFNDSKTTPLGSKMNKLEKLRFNSKIKSRLGSAIAANKFLEAARTYCVDSLYHEVSSANAIGKGKIFIEYYLEILSQNYIEAAQKQLQRFIESIEQWFVADPFQGRLKQYFKDDLKRAKCFLCANREVQTTCYAAVKLHKSCAEKVKDKNKELAIKERNNKEDAVIKEVEASNYPRVIRLKLTKTITNKAM

SEQ ID NO: 103 - protein, 726 aa, Artificial Sequence
  source: /note="Description of Artificial Sequence: Synthetic polypeptide"
SESENKIIEQYYAFLYSFRDKYEKPEFKNRGDIKRKLQNKWEDFLKEQNLKNDKKLSNYIFSNRNFRRSYDREEENEEGIDEKKSKPKRINCFEKEKNLKDQYDKDAINASANKDGAQKWGCFECIFFPMYKIESGDPNKRIIINKTRFKLFDFYLNLKGCKSCLRSTYHPYRSNVYIESNYDKLKREIGNFLQQKNIFQRMRKAKVSEGKYLTNLDEYRLSCVAMHFKNRWLFFDSIQKVLRETIKQRLKQMRESYDEQAKTKRSKGHGRAKYEDQVRMIRRRAYSAQAHKLLDNGYITLFDYDDKEINKVCLTAINQEGFDIGGYLNSDIDNVMPPIEISFHLKWKYNEPILNIESPFSKAKISDYLRKIREDLNLERGKEGKARSKKNVRRKVLASKGEDGYKKIFTDFFSKWKEELEGNAMERVLSQSSGDIQWSKKKRIHYTTLVLNINLLDKKGVGNLKYYEIAEKTKILSFDKNENKFWPITIQVLLDGYEIGTEYDEIKQLNEKTSKQFTIYDPNTKIIKIPFTDSKAVPLGMLGINIATLKTVKKTERDIKVSKIFKGGLNSKIVSKIGKGIYAGYFPTVDKEILEEVEEDTLDNEFSSKSQRNIFLKSIIKNYDKMLKEQLFDFYSFLVRNDLGVRFLTDRELQNIEDESFNLEKRFFETDRDRIARWFDNTNTDDGKEKFKKLANEIVDSYKPRLIRLPVVRVIKRIQPVKQREM

SEQ ID NO: 104 - protein, 517 aa, Artificial Sequence
  source: /note="Description of Artificial Sequence: Synthetic polypeptide"
KYSTRDFSELNEIQVTACKQDEFFKVIQNAWREIIKKRFLENRENFIEKKIFKNKKGRGKRQESDKTIQRNRASVMKNFQLIENEKIILRAPSGHVACVFPVKVGLDIGGFKTDDLEKNIFPPRTITINVFWKNRDRQRKGRKLEVWGIKARTKLIEKVHKWDKLEEVKKKRLKSLEQKQEKSLDNWSEVNNDSFYKVQIDELQEKIDKSLKGRTMNKILDNKAKESKEAEGLYIEWEKDFEGEMLRRIEASTGGEEKWGKRRQRRHTSLLLDIKNNSRGSKEIINFYSYAKQGKKEKKIEFFPFPLTITLDAEEESPLNIKSIPIEDKNATSKYFSIPFTETRATPLSILGDRVQKFKTKNISGAIKRNLGSSISSCKIVQNAETSAKSILSLPNVKEDNNMEIFINTMSKNYFRAMMKQMESFIFEMEPKTLIDPYKEKAIKWFEVAASSRAKRKLKKLSKADIKKSELLLSNTEEFEKEKQEKLEALEKEIEEFYLPRIVRLQLTKTILETPVM

SEQ ID NO: 105 - protein, 481 aa, Artificial Sequence
  source: /note="Description of Artificial Sequence: Synthetic polypeptide"
KKLQLLGHKILLKEYDPNAVNAAANFETSTAELCGQCKMKPFKNKRRFQYTFGKNYHGCLSCIQNVYYAKKRIVQIAKEELKHQLTDSIASIPYKYTSLFSNTNSIDELYILKQERAAFFSNTNSIDELYITGIENNIAFKVISAIWDEIIKKRRQRYAESLTDTGTVKANRGHGGTAYKSNTRQEKIRALQKQTLHMVTNPYISLARYKNNYIVATLPRTIGMHIGAIKDRDPQKKLSDYAINFNVFWSDDRQLIELSTVQYTGDMVRKIEAETGENNKWGENMKRTKTSLLLEILTKKTTDELTFKDWAFSTKKEIDSVTKKTYQGFPIGIIFEGNESSVKFGSQNYFPLPFDAKITPPTAEGFRLDWLRKGSFSSQMKTSYGLAIYSNKVTNAIPAYVIKNMFYKIARAENGKQIKAKFLKKYLDIAGNNYVPFIIMQHYRVLDTFEEMPISQPKVIRLSLTKTQHIIIKKDKTDSKM

SEQ ID NO: 106 - protein, 534 aa, Artificial Sequence
  source: /note="Description of Artificial Sequence: Synthetic polypeptide"
NTSNLINLGKKAINISANYDANLEVGCKNCKFLSSNGNFPRQTNVKEGCHSCEKSTYEPSIYLVKIGERKAKYDVLDSLKKFTFQSLKYQSKKSMKSRNKKPKELKEFVIFANKNKAFDVIQKSYNHLILQIKKEINRMNSKKRKKNHKRRLFRDREKQLNKLRLIESSNLFLPRENKGNNHVFTYVAIHSVGRDIGVIGSYDEKLNFETELTYQLYFNDDKRLLYAYKPKQNKIIKIKEKLWNLRKEKEPLDLEYEKPLNKSITFSIKNDNLFKVSKDLMLRRAKFNIQGKEKLSKEERKINRDLIKIKGLVNSMSYGRFDELKKEKNIWSPHIYREVRQKEIKPCLIKNGDRIEIFEQLKKKMERLRRFREKRQKKISKDLIFAERIAYNFHTKSIKNTSNKINIDQEAKRGKASYMRKRIGYETFKNKYCEQCLSKGNVYRNVQKGCSCFENPFDWIKKGDENLLPKKNEDLRVKGAFRDEALEKQIVKIAFNIAKGYEDFYDNLGESTEKDLKLKFKVGTTINEQESLKL

SEQ ID NO: 107 - protein, 537 aa, Artificial Sequence
  source: /note="Description of Artificial Sequence: Synthetic polypeptide"
TSNPIKLGKKAINISANYDSNLQIGCKNCKFLSYNGNFPRQTNVKEGCHSCEKSTYEPPVYTVRIGERRSKYDVLDSLKKFIFLSLKYRQSKKMKTRSKGIRGLEEFVISANLKKAMDVIQKSYRHLILNIKNEIVRMNGKKRNKNHKRLLFRDREKQLNKLRLIEGSSFFKPPTVKGDNSIFTCVAIHNIGRDIGIAGDYFDKLEPKIELTYQLYYEYNPKKESEINKRLLYAYKPKQNKIIEIKEKLWNLRKEKSPLDLEYEKPLTKSITFLVKRDGVFRISKDLMLRKAKFIIQGKEKLSKEERKINRDLIKIKSNIISLTYGRFDELKKDKTIWSPHIFRDVKQGKITPCIERKGDRMDIFQQLRKKSERLRENRKKRQKKISKDLIFAERIAYNFHTKSIKNTSNLINIKHEAKRGKASYMRKRIGNETFRIKYCEQCFPKNNVYKNVQKGCSCFEDPFEYIKKGNEDLIPNKNQDLKAKGAFRDDALEKQIIKVAFNIAKGYEDFYENLKKTTEKDIRLKFKVGTIISEEM

SEQ ID NO: 108 - protein, 541 aa, Artificial Sequence
  source: /note="Description of Artificial Sequence: Synthetic polypeptide"
NNSINLSKKAINISANYDANLQVRCKNCKFLSSNGNFPRQTDVKEGCHSCEKSTYEPPVYDVKIGEIKAKYEVLDSLKKFTFQSLKYQLSKSMKFRSKKIKELKEFVIFAKESKALNVINRSYKHLILNIKNDINRMNSKKRIKNHKGRLFLDRQKQLSKLKLIEGSSFFVPAKNVGNKSVFTCVAIHSIGRDIGIAGLYDSFTKPVNEITYQIFFSGERRLLYAYKPKQLKILSIKENLWSLKNEKKPLDLLYEKPLGKNLNFNVKGGDLFRVSKDLMIRNAKFNVHGRQRLSDEERLINRNFIKIKGEVVSLSYGRFEELKKDRKLWSPHIFKDVRQNKIKPCLVMQGQRIDIFEQLKRKLELLKKIRKSRQKKLSKDLIFGERIAYNFHTKSIKNTSNKINIDSDAKRGRASYMRKRIGNETFKLKYCDVCFPKANVYRRVQNGCSCSENPYNYIKKGDKDLLPKKDEGLAIKGAFRDEKLNKQIIKVAFNIAKGYEDFYDDLKKRTEKDVDLKFKIGTTVLDQKPMEIFDGIVITWL

SEQ ID NO: 109 - protein, 542 aa, Artificial Sequence
  source: /note="Description of Artificial Sequence: Synthetic polypeptide"
LLTTVVETNNLAKKAINVAANFDANIDRQYYRCTPNLCRFIAQSPRETKEKDAGCSSCTQSTYDPKVYVIKIGKLLAKYEILKSLKRFLFMNRYFKQKKTERAQQKQKIGTELNEMSIFAKATNAMEVIKRATKHCTYDIIPETKSLQMLKRRRHRVKVRSLLKILKERRMKIKKIPNTFIEIPKQAKKNKSDYYVAAALKSCGIDVGLCGAYEKNAEVEAEYTYQLYYEYKGNSSTKRILYCYNNPQKNIREFWEAFYIQGSKSHVNTPGTIRLKMEKFLSPITIESEALDFRVWNSDLKIRNGQYGFIKKRSLGKEAREIKKGMGDIKRKIGNLTYGKSPSELKSIHVYRTERENPKKPRAARKKEDNFMEIFEMQRKKDYEVNKKRRKEATDAAKIMDFAEEPIRHYHTNNLKAVRRIDMNEQVERKKTSVFLKRIMQNGYRGNYCRKCIKAPEGSNRDENVLEKNEGCLDCIGSEFIWKKSSKEKKGLWHTNRLLRRIRLQCFTTAKAYENFYNDLFEKKESSLDIIKLKVSITTKSM

SEQ ID NO: 110 - protein, 564 aa, Artificial Sequence
  source: /note="Description of Artificial Sequence: Synthetic polypeptide"
ASTMNLAKQAINFAANYDSNLEIGCKGCKFMSTWSKKSNPKFYPRQNNQANKCHSCTYSTGEPEVPIIEIGERAAKYKIFTALKKFVFMSVAYKERRRQRFKSKKPKELKELAICSNREKAMEVIQKSVVHCYGDVKQEIPRIRKIKVLKNHKGRLFYKQKRSKIKIAKLEKGSFFKTFIPKVHNNGCHSCHEASLNKPILVTTALNTIGADIGLINDYSTIAPTETDISWQVYYEFIPNGDSEAVKKRLLYFYKPKGALIKSIRDKYFKKGHENAVNTGFFKYQGKIVKGPIKFVNNELDFARKPDLKSMKIKRAGFAIPSAKRLSKEDREINRESIKIKNKIYSLSYGRKKTLSDKDIIKHLYRPVRQKGVKPLEYRKAPDGFLEFFYSLKRKERRLRKQKEKRQKDMSEIIDAADEFAWHRHTGSIKKTTNHINFKSEVKRGKVPIMKKRIANDSFNTRHCGKCVKQGNAINKYYIEKQKNCFDCNSIEFKWEKAALEKKGAFKLNKRLQYIVKACFNVAKAYESFYEDFRKGEEESLDLKFKIGTTTTLKQYPQNKARAM

SEQ ID NO: 111 - protein, 610 aa, Artificial Sequence
  source: /note="Description of Artificial Sequence: Synthetic polypeptide"
HSHNLMLTKLGKQAINFAANYDANLEIGCKNCKFLSYSPKQANPKKYPRQTDVHEDGNIACHSCMQSTKEPPVYIVPIGERKSKYEILTSLNKFTFLALKYKEKKRQAFRAKKPKELQELAIAFNKEKAIKVIDKSIQHLILNIKPEIARIQRQKRLKNRKGKLLYLHKRYAIKMGLIKNGKYFKVGSPKKDGKKLLVLCALNTIGRDIGIIGNIEENNRSETEITYQLYFDCLDANPNELRIKEIEYNRLKSYERKIKRLVYAYKPKQTKILEIRSKFFSKGHENKVNTGSFNFENPLNKSISIKVKNSAFDFKIGAPFIMLRNGKFHIPTKKRLSKEEREINRTLSKIKGRVFRLTYGRNISEQGSKSLHIYRKERQHPKLSLEIRKQPDSFIDEFEKLRLKQNFISKLKKQRQKKLADLLQFADRIAYNYHTSSLEKTSNFINYKPEVKRGRTSYIKKRIGNEGFEKLYCETCIKSNDKENAYAVEKEELCFVCKAKPFTWKKTNKDKLGIFKYPSRIKDFIRAAFTVAKSYNDFYENLKKKDLKNEIFLKFKIGLILSHEKKNHISIAKSVAEDERISGKSIKNILNKSIKLEKNCYSCFFHKEDM

SEQ ID NO: 112 - protein, 552 aa, Artificial Sequence
  source: /note="Description of Artificial Sequence: Synthetic polypeptide"
SLERVIDKRNLAKKAINIAANFDANINKGFYRCETNQCMFIAQKPRKTNNTGCSSCLQSTYDPVIYVVKVGEMLAKYEILKSLKRFVFMNRSFKQKKTEKAKQKERIGGELNEMSIFANAALAMGVIKRAIRHCHVDIRPEINRLSELKKTKHRVAAKSLVKIVKQRKTKWKGIPNSFIQIPQKARNKDADFYVASALKSGGIDIGLCGTYDKKPHADPRWTYQLYFDTEDESEKRLLYCYNDPQAKIRDFWKTFYERGNPSMVNSPGTIEFRMEGFFEKMTPISIESKDFDFRVWNKDLLIRRGLYEIKKRKNLNRKAREIKKAMGSVKRVLANMTYGKSPTDKKSIPVYRVEREKPKKPRAVRKEENELADKLENYRREDFLIRNRRKREATEIAKIIDAAEPPIRHYHTNHLRAVKRIDLSKPVARKNTSVFLKRIMQNGYRGNYCKKCIKGNIDPNKDECRLEDIKKCICCEGTQNIWAKKEKLYTGRINVLNKRIKQMKLECFNVAKAYENFYDNLAALKEGDLKVLKLKVSIPALNPEASDPEEDM

SEQ ID NO: 113 - protein, 534 aa, Artificial Sequence
  source: /note="Description of Artificial Sequence: Synthetic polypeptide"
NASINLGKRAINLSANYDSNLVIGCKNCKFLSFNGNFPRQTNVREGCHSCDKSTYAPEVYIVKIGERKAKYDVLDSLKKFTFQSLKYQIKKSMRERSKKPKELLEFVIFANKDKAFNVIQKSYEHLILNIKQEINRMNGKKRIKNHKKRLFKDREKQLNKLRLIGSSSLFFPRENKGDKDLFTYVAIHSVGRDIGVAGSYESHIEPISDLTYQLFINNEKRLLYAYKPKQNKIIELKENLWNLKKEKKPLDLEFTKPLEKSITFSVKNDKLFKVSKDLMLRQAKFNIQGKEKLSKEERQINRDFSKIKSNVISLSYGRFEELKKEKNIWSPHIYREVKQKEIKPCIVRKGDRIELFEQLKRKMDKLKKFRKERQKKISKDLNFAERIAYNFHTKSIKNTSNKINIDQEAKRGKASYMRKRIGNESFRKKYCEQCFSVGNVYHNVQNGCSCFDNPIELIKKGDEGLIPKGKEDRKYKGALRDDNLQMQIIRVAFNIAKGYEDFYNNLKEKTEKDLKLKFKIGTTISTQESNNKEM

SEQ ID NO: 114 - protein, 577 aa, Artificial Sequence
  source: /note="Description of Artificial Sequence: Synthetic polypeptide"
SNLIKLGKQAINFAANYDANLEVGCKNCKFLSSTNKYPRQTNVHLDNKMACRSCNQSTMEPAIYIVRIGEKKAKYDIYNSLTKFNFQSLKYKAKRSQRFKPKQPKELQELSIAVRKEKALDIIQKSIDHLIQDIRPEIPRIKQQKRYKNHVGKLFYLQKRRKNKLNLIGKGSFFKVFSPKEKKNELLVICALTNIGRDIGLIGNYNTIINPLFEVTYQLYYDYIPKKNNKNVQRRLLYAYKSKNEKILKLKEAFFKRGHENAVNLGSFSYEKPLEKSLTLKIKNDKDDFQVSPSLRIRTGRFFVPSKRNLSRQEREINRRLVKIKSKIKNMTYGKFETARDKQSVHIFRLERQKEKLPLQFRKDEKEFMEEFQKLKRRTNSLKKLRKSRQKKLADLLQLSEKVVYNNHTGTLKKTSNFLNFSSSVKRGKTAYIKELLGQEGFETLYCSNCINKGQKTRYNIETKEKCFSCKDVPFVWKKKSTDKDRKGAFLFPAKLKDVIKATFTVAKAYEDFYDNLKSIDEKKPYIKFKIGLILAHVRHEHKARAKEEAGQKNIYNKPIKIDKNCKECFFFKEEAM

SEQ ID NO: 115 - protein, 613 aa, Artificial Sequence
  source: /note="Description of Artificial Sequence: Synthetic polypeptide"
NTTRKKFRKRTGFPQSDNIKLAYCSAIVRAANLDADIQKKHNQCNPNLCVGIKSNEQSRKYEHSDRQALLCYACNQSTGAPKVDYIQIGEIGAKYKILQMVNAYDFLSLAYNLTKLRNGKSRGHQRMSQLDEVVIVADYEKATEVIKRSINHLLDDIRGQLSKLKKRTQNEHITEHKQSKIRRKLRKLSRLLKRRRWKWGTIPNPYLKNWVFTKKDPELVTVALLHKLGRDIGLVNRSKRRSKQKLLPKVGFQLYYKWESPSLNNIKKSKAKKLPKRLLIPYKNVKLFDNKQKLENAIKSLLESYQKTIKVEFDQFFQNRTEEIIAEEQQTLERGLLKQLEKKKNEFASQKKALKEEKKKIKEPRKAKLLMEESRSLGFLMANVSYALFNTTIEDLYKKSNVVSGCIPQEPVVVFPADIQNKGSLAKILFAPKDGFRIKFSGQHLTIRTAKFKIRGKEIKILTKTKREILKNIEKLRRVWYREQHYKLKLFGKEVSAKPRFLDKRKTSIERRDPNKLADQTDDRQAELRNKEYELRHKQHKMAERLDNIDTNAQNLQTLSFWVGEADKPPKLDEKDARGFGVRTCISAWKWFMEDLLKKQEEDPLLKLKLSIM

SEQ ID NO: 116 - protein, 615 aa, Artificial Sequence
  source: /note="Description of Artificial Sequence: Synthetic polypeptide"
PKKPKFQKRTGFPQPDNLRKEYCLAIVRAANLDADFEKKCTKCEGIKTNKKGNIVKGRTYNSADKDNLLCYACNISTGAPAVDYVFVGALEAKYKILQMVKAYDFHSLAYNLAKLWKGRGRGHQRMGGLNEVVIVSNNEKALDVIEKSLNHFHDEIRGELSRLKAKFQNEHLHVHKESKLRRKLRKISRLLKRRRWKWDVIPNSYLRNFTFTKTRPDFISVALLHRVGRDIGLVTKTKIPKPTDLLPQFGFQIYYTWDEPKLNKLKKSRLRSEPKRLLVPYKKIELYKNKSVLEEAIRHLAEVYTEDLTICFKDFFETQKRKFVSKEKESLKRELLKELTKLKKDFSERKTALKRDRKEIKEPKKAKLLMEESRSLGFLAANTSYALFNLIAADLYTKSKKACSTKLPRQLSTILPLEIKEHKSTTSLAIKPEEGFKIRFSNTHLSIRTPKFKMKGADIKALTKRKREILKNATKLEKSWYGLKHYKLKLYGKEVAAKPRFLDKRNPSIDRRDPKELMEQIENRRNEVKDLEYEIRKGQHQMAKRLDNVDTNAQNLQTKSFWVGEADKPPELDSMEAKKLGLRTCISAWKWFMKDLVLLQEKSPNLKLKLSLTEM

SEQ ID NO: 117 - protein, 775 aa, Artificial Sequence
  source: /note="Description of Artificial Sequence: Synthetic polypeptide"
KFSKRQEGFLIPDNIDLYKCLAIVRSANLDADVQGHKSCYGVKKNGTYRVKQNGKKGVKEKGRKYVFDLIAFKGNIEKIPHEAIEEKDQGRVIVLGKFNYKLILNIEKNHNDRASLEIKNKIKKLVQISSLETGEFLSDLLSGKIGIDEVYGIIEPDVFSGKELVCKACQQSTYAPLVEYMPVGELDAKYKILSAIKGYDFLSLAYNLSRNRANKKRGHQKLGGGELSEVVISANYDKALNVIKRSINHYHVEIKPEISKLKKKMQNEPLKVMKQARIRRELHQLSRKVKRLKWKWGMIPNPELQNIIFEKKEKDFVSYALLHTLGRDIGLFKDTSMLQVPNISDYGFQIYYSWEDPKLNSIKKIKDLPKRLLIPYKRLDFYIDTILVAKVIKNLIELYRKSYVYETFGEEYGYAKKAEDILFDWDSINLSEGIEQKIQKIKDEFSDLLYEARESKRQNFVESFENILGLYDKNFASDRNSYQEKIQSMIIKKQQENIEQKLKREFKEVIERGFEGMDQNKKYYKVLSPNIKGGLLYTDTNNLGFFRSHLAFMLLSKISDDLYRKNNLVSKGGNKGILDQTPETMLTLEFGKSNLPNISIKRKFFNIKYNSSWIGIRKPKFSIKGAVIREITKKVRDEQRLIKSLEGVWHKSTHFKRWGKPRFNLPRHPDREKNNDDNLMESITSRREQIQLLLREKQKQQEKMAGRLDKIDKEIQNLQTANFQIKQIDKKPALTEKSEGKQSVRNALSAWKWFMEDLIKYQKRTPILQLKLAKM

SEQ ID NO: 118 - protein, 777 aa, Artificial Sequence
  source: /note="Description of Artificial Sequence: Synthetic polypeptide"
KFSKRQEGFVIPENIGLYKCLAIVRSANLDADVQGHVSCYGVKKNGTYVLKQNGKKSIREKGRKYASDLVAFKGDIEKIPFEVIEEKKKEQSIVLGKFNYKLVLDVMKGEKDRASLTMKNKSKKLVQVSSLGTDEFLLTLLNEKFGIEEIYGIIEPEVFSGKKLVCKACQQSTYAPLVEYMPVGELDSKYKILSAIKGYDFLSLAYNLARHRSNKKRGHQKLGGGELSEVVISANNAKALNVIKRSLNHYYSEIKPEISKLRKKMQNEPLKVGKQARMRRELHQLSRKVKRLKWKWGKIPNLELQNITFKESDRDFISYALLHTLGRDIGMFNKTEIKMPSNILGYGFQIYYDWEEPKLNTIKKSKNTPKRILIPYKKLDFYNDSILVARAIKELVGLFQESYEWEIFGNEYNYAKEAEVELIKLDEESINGNVEKKLQRIKENFSNLLEKAREKKRQNFIESFESIARLYDESFTADRNEYQREIQSFIIEKQKQSIEKKLKNEFKKIVEKKFNEQEQGKKHYRVLNPTIINEFLPKDKNNLGFLRSKIAFILLSKISDDLYKKSNAVSKGGEKGIIKQQPETILDLEFSKSKLPSINIKKKLFNIKYTSSWLGIRKPKFNIKGAKIREITRRVRDVQRTLKSAESSWYASTHFRRWGFPRFNQPRHPDKEKKSDDRLIESITLLREQIQILLREKQKGQKEMAGRLDDVDKKIQNLQTANFQIKQTGDKPALTEKSAGKQSFRNALSAWKWFMENLLKYQNKTPDLKLKIARTVM

SEQ ID NO: 119 - protein, 610 aa, Artificial Sequence
  source: /note="Description of Artificial Sequence: Synthetic polypeptide"
KWIEPNNIDFNKCLAITRSANLDADVQGHKMCYGIKTNGTYKAIGKINKKHNTGIIEKRRTYVYDLIVTKEKNEKIVKKTDFMAIDEEIEFDEKKEKLLKKYIKAEVLGTGELIRKDLNDGEKFDDLCSIEEPQAFRRSELVCKACNQSTYASDIRYIPIGEIEAKYKILKAIKGYDFLSLKYNLGRLRDSKKRGHQKMGQGELKEFVICANKEKALDVIKRSLNHYLNEVKDEISRLNKKMQNEPLKVNDQARWRRELNQISRRLKRLKWKWGEIPNPELKNLIFKSSRPEFVSYALIHTLGRDIGLINETELKPNNIQEYGFQIYYKWEDPELNHIKKVKNIPKRFIIPYKNLDLFGKYTILSRAIEGILKLYSSSFQYKSFKDPNLFAKEGEKKITNEDFELGYDEKIKKIKDDFKSYKKALLEKKKNTLEDSLNSILSVYEQSLLTEQINNVKKWKEGLLKSKESIHKQKKIENIEDIISRIEELKNVEGWIRTKERDIVNKEETNLKREIKKELKDSYYEEVRKDFSDLKKGEESEKKPFREEPKPIVIKDYIKFDVLPGENSALGFFLSHLSFNLFDSIQYELFEKSRLSSSKHPQIPETILDL

SEQ ID NO: 120 - protein, 632 aa, Artificial Sequence
  source: /note="Description of Artificial Sequence: Synthetic polypeptide"
FRKFVKRSGAPQPDNLNKYKCIAIVRAANLDADIMSNESSNCVMCKGIKMNKRKTAKGAAKTTELGRVYAGQSGNLLCTACTKSTMGPLVDYVPIGRIRAKYTILRAVKEYDFLSLAYNLARTRVSKKGGRQKMHSLSELVIAAEYEIAWNIIKSSVIHYHQETKEEISGLRKKLQAEHIHKNKEARIRREMHQISRRIKRLKWKWHMIPNSELHNFLFKQQDPSFVAVALLHTLGRDIGMINKPKGSAKREFIPEYGFQIYYKWMNPKLNDINKQKYRKMPKRSLIPYKNLNVFGDRELIENAMHKLLKLYDENLEVKGSKFFKTRVVAISSKESEKLKRDLLWKGELAKIKKDFNADKNKMQELFKEVKEPKKANALMKQSRNMGFLLQNISYGALGLLANRMYEASAKQSKGDATKQPSIVIPLEMEFGNAFPKLLLRSGKFAMNVSSPWLTIRKPKFVIKGNKIKNITKLMKDEKAKLKRLETSYHRATHFRPTLRGSIDWDSPYFSSPKQPNTHRRSPDRLSADITEYRGRLKSVEAELREGQRAMAKKLDSVDMTASNLQTSNFQLEKGEDPRLTEIDEKGRSIRNCISSWKKFMEDLMKAQEANPVIKIKIALKDESSVLSEDSM

SEQ ID NO: 121 - protein, 625 aa, Artificial Sequence
  source: /note="Description of Artificial Sequence: Synthetic polypeptide"
KFHPENLNKSYCLAIVRAANLDADIQGHINCIGIKSNKSDRNYENKLESLQNVELLCKACTKSTYKPNINSVPVGEKKAKYSILSEIKKYDFNSLVYNLKKYRKGKSRGHQKLNELRELVITSEYKKALDVINKSVNHYLVNIKNKMSKLKKILQNEHIHVGTLARIRRERNRISRKLDHYRKKWKFVPNKILKNYVFKNQSPDFVSVALLHKLGRDIGLITKTAILQKSFPEYSLQLYYKYDTPKLNYLKKSKFKSLPKRILISYKYPKFDINSNYIEESIDKLLKLYEESPIYKNNSKIIEFFKKSEDNLIKSENDSLKRGIMKEFEKVTKNFSSKKKKLKEELKLKNEDKNSKMLAKVSRPIGFLKAYLSYMLFNIISNRIFEFSRKSSGRIPQLPSCIINLGNQFENFKNELQDSNIGSKKNYKYFCNLLLKSSGFNISYEEEHLSIKTPNFFINGRKLKEITSEKKKIRKENEQLIKQWKKLTFFKPSNLNGKKTSDKIRFKSPNNPDIERKSEDNIVENIAKVKYKLEDLLSEQRKEFNKLAKKHDGVDVEAQCLQTKSFWIDSNSPIKKSLEKKNEKVSVKKKMKAIRSCISAWKWFMADLIEAQKETPMIKLKLALM

SEQ ID NO: 122 - protein, 517 aa, Artificial Sequence
  source: /note="Description of Artificial Sequence: Synthetic polypeptide"
TTLVPSHLAGIEVMDETTSRNEDMIQKETSRSNEDENYLGVKNKCGINVHKSGRGSSKHEPNMPPEKSGEGQMPKQDSTEMQQRFDESVTGETQVSAGATASIKTDARANSGPRVGTARALIVKASNLDRDIKLGCKPCEYIRSELPMGKKNGCNHCEKSSDIASVPKVESGFRKAKYELVRRFESFAADSISRHLGKEQARTRGKRGKKDKKEQMGKVNLDEIAILKNESLIEYTENQILDARSNRIKEWLRSLRLRLRTRNKGLKKSKSIRRQLITLRRDYRKWIKPNPYRPDEDPNENSLRLHTKLGVDIGVQGGDNKRMNSDDYETSFSITWRDTATRKICFTKPKGLLPRHMKFKLRGYPELILYNEELRIQDSQKFPLVDWERIPIFKLRGVSLGKKKVKALNRITEAPRLVVAKRIQVNIESKKKKVLTRYVYNDKSINGRLVKAEDSNKDPLLEFKKQAEEINSDAKYYENQEIAKNYLWGCEGLHKNLLEEQTKNPYLAFKYGFLNIV

SEQ ID NO: 123 - protein, 410 aa, Artificial Sequence
  source: /note="Description of Artificial Sequence: Synthetic polypeptide"
LDFKRTCSQELVLLPEIEGLKLSGTQGVTSLAKKLINKAANVDRDESYGCHHCIHTRTSLSKPVKKDCNSCNQSTNHPAVPITLKGYKIAFYELWHRFTSWAVDSISKALHRNKVMGKVNLDEYAVVDNSHIVCYAVRKCYEKRQRSVRLHKRAYRCRAKHYNKSQPKVGRIYKKSKRRNARNLKKEAKRYFQPNEITNGSSDALFYKIGVDLGIAKGTPETEVKVDVSICFQVYYGDARRVLRVRKMDELQSFHLDYTGKLKLKGIGNKDTFTIAKRNESLKWGSTKYEVSRAHKKFKPFGKKGSVKRKCNDYFRSIASWSCEAASQRAQSNLKNAFPYQKALVKCYKNLDYKGVKKNDMWYRLCSNRIFRYSRIAEDIAQYQSDKGKAKFEFVILAQSVAEYDISAIM

SEQ ID NO: 124 - protein, 602 aa, Artificial Sequence
  source: /note="Description of Artificial Sequence: Synthetic polypeptide"
VFLTDDKRKTALRKIRSAFRKTAEIALVRAQEADSLDRQAKKLTIETVSFGAPGAKNAFIGSLQGYNWNSHRANVPSSGSAKDVFRITELGLGIPQSAHEASIGKSFELVGNVVRYTANLLSKGYKKGAVNKGAKQQREIKGKEQLSFDLISNGPISGDKLINGQKDALAWWLIDKMGFHIGLAMEPLSSPNTYGITLQAFWKRHTAPRRYSRGVIRQWQLPFGRQLAPLIHNFFRKKGASIPIVLTNASKKLAGKGVLLEQTALVDPKKWWQVKEQVTGPLSNIWERSVPLVLYTATFTHKHGAAHKRPLTLKVIRISSGSVFLLPLSKVTPGKLVRAWMPDINILRDGRPDEAAYKGPDLIRARERSFPLAYTCVTQIADEWQKRALESNRDSITPLEAKLVTGSDLLQIHSTVQQAVEQGIGGRISSPIQELLAKDALQLVLQQLFMTVDLLRIQWQLKQEVADGNTSEKAVGWAIRISNIHKDAYKTAIEPCTSALKQAWNPLSGFEERTFQLDASIVRKRSTAKTPDDELVIVLRQQAAEMTVAVTQSVSKELMELAVRHSATLHLLVGEVASKQLSRSADKDRGAMDHWKLLSQSM

SEQ ID NO: 125 - protein, 494 aa, Artificial Sequence
  source: /note="Description of Artificial Sequence: Synthetic polypeptide"
EDLLQKALNTATNVAAIERHSCISCLFTESEIDVKYKTPDKIGQNTAGCQSCTFRVGYSGNSHTLPMGNRIALDKLRETIQRYAWHSLLFNVPPAPTSKRVRAISELRVAAGRERLFTVITFVQTNILSKLQKRYAANWTPKSQERLSRLREEGQHILSLLESGSWQQKEVVREDQDLIVCSALTKPGLSIGAFCRPKYLKPAKHALVLRLIFVEQWPGQIWGQSKRTRRMRRRKDVERVYDISVQAWALKGKETRISECIDTMRRHQQAYIGVLPFLILSGSTVRGKGDCPILKEITRMRYCPNNEGLIPLGIFYRGSANKLLRVVKGSSFTLPMWQNIETLPHPEPFSPEGWTATGALYEKNLAYWSALNEAVDWYTGQILSSGLQYPNQNEFLARLQNVIDSIPRKWFRPQGLKNLKPNGQEDIVPNEFVIPQNAIRAHHVIEWYHKTNDLVAKTLLGWGSQTTLNQTRPQGDLRFTYTRYYFREKEVPEV

SEQ ID NO: 126 - protein, 649 aa, Artificial Sequence
  source: /note="Description of Artificial Sequence: Synthetic polypeptide"
VPKKKLMRELAKKAVFEAIFNDPIPGSFGCKRCTLIDGARVTDAIEKKQGAKRCAGCEPCTFHTLYDSVKHALPAATGCDRTAIDTGLWEILTALRSYNWMSFRRNAVSDASQKQVWSIEELAIWADKERALRVILSALTHTIGKLKNGFSRDGVWKGGKQLYENLAQKDLAKGLFANGEIFGKELVEADHDMLAWTIVPNHQFHIGLIRGNWKPAAVEASTAFDARWLTNGAPLRDTRTHGHRGRRFNRTEKLTVLCIKRDGGVSEEFRQERDYELSVMLLQPKNKLKPEPKGELNSFEDLHDHWWFLKGDEATALVGLTSDPTVGDFIQLGLYIRNPIKAHGETKRRLLICFEPPIKLPLRRAFPSEAFKTWEPTINVFRNGRRDTEAYYDIDRARVFEFPETRVSLEHLSKQWEVLRLEPDRENTDPYEAQQNEGAELQVYSLLQEAAQKMAPKVVIDPFGQFPLELFSTFVAQLFNAPLSDTKAKIGKPLDSGFVVESHLHLLEEDFAYRDFVRVTFMGTEPTFRVIHYSNGEGYWKKTVLKGKNNIRTALIPEGAKAAVDAYKNKRCPLTLEAAILNEEKDRRLVLGNKALSLLAQTARGNLTILEALAAEVLRPLSGTEGVVHLHACVTRHSTLTESTETDNM

SEQ ID NO: 127 - protein, 414 aa, Artificial Sequence
  source: /note="Description of Artificial Sequence: Synthetic polypeptide"
VEKLFSERLKRAMWLKNEAGRAPPAETLTLKHKRVSGGHEKVKEELQRVLRSLSGTNQAAWNLGLSGGREPKSSDALKGEKSRVVLETVVFHSGHNRVLYDVIEREDQVHQRSSIMHMRRKGSNLLRLWGRSGKVRRKMREEVAEIKPVWHKDSRWLAIVEEGRQSVVGISSAGLAVFAVQESQCTTAEPKPLEYVVSIWFRGSKALNPQDRYLEFKKLKTTEALRGQQYDPIPFSLKRGAGCSLAIRGEGIKFGSRGPIKQFFGSDRSRPSHADYDGKRRLSLFSKYAGDLADLTEEQWNRTVSAFAEDEVRRATLANIQDFLSISHEKYAERLKKRIESIEEPVSASKLEAYLSAIFETFVQQREALASNFLMRLVESVALLISLEEKSPRVEFRVARYLAESKEGFNRKAM

SEQ ID NO: 128 - protein, 413 aa, Artificial Sequence
  source: /note="Description of Artificial Sequence: Synthetic polypeptide"
VVITQSELYKERLLRVMEIKNDRGRKEPRESQGLVLRFTQVTGGQEKVKQKLWLIFEGFSGTNQASWNFGQPAGGRKPNSGDALKGPKSRVTYETVVFHFGLRLLSAVIERHNLKQQRQTMAYMKRRAAARKKWARSGKKCSRMRNEVEKIKPKWHKDPRWFDIVKEGEPSIVGISSAGFAIYIVEEPNFPRQDPLEIEYAISIWFRRDRSQYLTFKKIQKAEKLKELQYNPIPFRLKQEKTSLVFESGDIKFGSRGSIEHFRDEARGKPPKADMDNNRRLTMFSVFSGNLTNLTEEQYARPVSGLLAPDEKRMPTLLKKLQDFFTPIHEKYGERIKQRLANSEASKRPFKKLEEYLPAIYLEFRARREGLASNWVLVLINSVRTLVRIKSEDPYIEFKVSQYLLEKEDNKAL

SEQ ID NO: 129 - protein, 449 aa, Artificial Sequence
  source: /note="Description of Artificial Sequence: Synthetic polypeptide"
KQDALFEERLKKAIFIKRQADPLQREELSLLPPNRKIVTGGHESAKDTLKQILRAINGTNQASWNPGTPSGKRDSKSADALAGPKSRVKLETVVFHVGHRLLKKVVEYQGHQKQQHGLKAFMRTCAAMRKKWKRSGKVVGELREQLANIQPKWHYDSRPLNLCFEGKPSVVGLRSAGIALYTIQKSVVPVKEPKPIEYAVSIWFRGPKAMDREDRCLEFKKLKIATELRKLQFEPIVSTLTQGIKGFSLYIQGNSVKFGSRGPIKYFSNESVRQRPPKADPDGNKRLALFSKFSGDLSDLTEEQWNRPILAFEGIIRRATLGNIQDYLTVGHEQFAISLEQLLSEKESVLQMSIEQQRLKKNLGKKAENEWVESFGAEQARKKAQGIREYISGFFQEYCSQREQWAENWVQQLNKSVRLFLTIQDSTPFIEFRVARYLPKGEKKKGKAM

SEQ ID NO: 130 - protein, 711 aa, Artificial Sequence
  source: /note="Description of Artificial Sequence: Synthetic polypeptide"
ANHAERHKRLRKEANRAANRNRPLVADCDTGDPLVGICRLLRRGDKMQPNKTGCRSCEQVEPELRDAILVSGPGRLDNYKYELFQRGRAMAVHRLLKRVPKLNRPKKAAGNDEKKAENKKSEIQKEKQKQRRMMPAVSMKQVSVADFKHVIENTVRHLFGDRRDREIAECAALRAASKYFLKSRRVRPRKLPKLANPDHGKELKGLRLREKRAKLKKEKEKQAELARSNQKGAVLHVATLKKDAPPMPYEKTQGRNDYTTFVISAAIKVGATRGTKPLLTPQPREWQCSLYWRDGQRWIRGGLLGLQAGIVLGPKLNRELLEAVLQRPIECRMSGCGNPLQVRGAAVDFFMTTNPFYVSGAAYAQKKFKPFGTKRASEDGAAAKAREKLMTQLAKVLDKVVTQAAHSPLDGIWETRPEAKLRAMIMALEHEWIFLRPGPCHNAAEEVIKCDCTGGHAILWALIDEARGALEHKEFYAVTRAHTHDCEKQKLGGRLAGFLDLLIAQDVPLDDAPAARKIKTLLEATPPAPCYKAATSIATCDCEGKFDKLWAIIDATRAGHGTEDLWARTLAYPQNVNCKCKAGKDLTHRLADFLGLLIKRDGPFRERPPHKVTGDRKLVFSGDKKCKGHQYVILAKAHNEEVVRAWISRWGLKSRTNKAGYAATELNLLLNWLSICRRRWMDMLTVQRDTPYIRMKTGRLVVDDKKERKAM

SEQ ID NO: 131 - protein, 574 aa, Artificial Sequence
  source: /note="Description of Artificial Sequence: Synthetic polypeptide"
AKQREALRVALERGIVRASNRTYTLVTNCTKGGPLPEQCRMIERGKARAMKWEPKLVGCGSCAAATVDLPAIEEYAQPGRLDVAKYKLTTQILAMATRRMMVRAAKLSRRKGQWPAKVQEEKEEPPEPKKMLKAVEMRPVAIVDFNRVIQTTIEHLWAERANADEAELKALKAAAAYFGPSLKIRARGPPKAAIGRELKKAHRKKAYAERKKARRKRAELARSQARGAAAHAAIRERDIPPMAYERTQGRNDVTTIPIAAAIKIAATRGARPLPAPKPMKWQCSLYWNEGQRWIRGGMLTAQAYAHAANIHRPMRCEMWGVGNPLKVRAFEGRVADPDGAKGRKAEFRLQTNAFYVSGAAYRNKKFKPFGTDRGGIGSARKKRERLMAQLAKILDKVVSQAAHSPLDDIWHTRPAQKLRAMIKQLEHEWMFLRPQAPTVEGTKPDVDVAGNMQRQIKALMAPDLPPIEKGSPAKRFTGDKRKKGERAVRVAEAHSDEVVTAWISRWGIQTRRNEGSYAAQELELLLNWLQICRRRWLDMTAAQRVSPYIRMKSGRMITDAADEGVAPIPLVENM

SEQ ID NO: 132 - protein, 743 aa, Artificial Sequence
  source: /note="Description of Artificial Sequence: Synthetic polypeptide"
KSISGRSIKHMACLKDMLKSEITEIEEKQKKESLRKWDYYSKFSDEILFRRNLNVSANHDANACYGCNPCAFLKEVYGFRIERRNNERIISYRRGLAGCKSCVQSTGYPPIEFVRRKFGADKAMEIVREVLHRRNWGALARNIGREKEADPILGELNELLLVDARPYFGNKSAANETNLAFNVITRAAKKFRDEGMYDIHKQLDIHSEEGKVPKGRKSRLIRIERKHKAIHGLDPGETWRYPHCGKGEKYGVWLNRSRLIHIKGNEYRCLTAFGTTGRRMSLDVACSVLGHPLVKKKRKKGKKTVDGTELWQIKKATETLPEDPIDCTFYLYAAKPTKDPFILKVGSLKAPRWKKLHKDFFEYSDTEKTQGQEKGKRVVRRGKVPRILSLRPDAKFKVSIWDDPYNGKNKEGTLLRMELSGLDGAKKPLILKRYGEPNTKPKNFVFWRPHITPHPLTFTPKHDFGDPNKKTKRRRVFNREYYGHLNDLAKMEPNAKFFEDREVSNKKNPKAKNIRIQAKESLPNIVAKNGRWAAFDPNDSLWKLYLHWRGRRKTIKGGISQEFQEFKERLDLYKKHEDESEWKEKEKLWENHEKEWKKTLEIHGSIAEVSQRCVMQSMMGPLDGLVQKKDYVHIGQSSLKAADDAWTFSANRYKKATGPKWGKISVSNLLYDANQANAELISQSISKYLSKQKDNQGCEGRKMKFLIKIIEPLRENFVKHTRWLHEMTQKDCEVRAQFSRVSM

SEQ ID NO: 133 - protein, 769 aa, Artificial Sequence
  source: /note="Description of Artificial Sequence: Synthetic polypeptide"
FPSDVGADALKHVRMLQPRLTDEVRKVALTRAPSDRPALARFAAVAQDGLAFVRHLNVSANHDSNCTFPRDPRDPRRGPCEPNPCAFLREVWGFRIVARGNERALSYRRGLAGCKSCVQSTGFPSVPFHRIGADDCMRKLHEILKARNWRLLARNIGREREADPLLTELSEYLLVDARTYPDGAAPNSGRLAENVIKRAAKKFRDEGMRDIHAQLRVHSREGKVPKGRLQRLRRIERKHRAIHALDPGPSWEAEGSARAEVQGVAVYRSQLLRVGHHTQQIEPVGIVARTLFGVGRTDLDVAVSVLGAPLTKRKKGSKTLESTEDFRIAKARETRAEDKIEVAFVLYPTASLLRDEIPKDAFPAMRIDRFLLKVGSVQADREILLQDDYYRFGDAEVKAGKNKGRTVTRPVKVPRLQALRPDAKFRVNVWADPFGAGDSPGTLLRLEVSGVTRRSQPLRLLRYGQPSTQPANFLCWRPHRVPDPMTFTPRQKFGERRKNRRTRRPRVFERLYQVHIKHLAHLEPNRKWFEEARVSAQKWAKARAIRRKGAEDIPVVAPPAKRRWAALQPNAELWDLYAHDREARKRFRGGRAAEGEEFKPRLNLYLAHEPEAEWESKRDRWERYEKKWTAVLEEHSRMCAVADRTLPQFLSDPLGARMDDKDYAFVGKSALAVAEAFVEEGTVERAQGNCSITAKKKFASNASRKRLSVANLLDVSDKADRALVFQAVRQYVQRQAENGGVEGRRMAFLRKLLAPLRQNFVCHTRWLHM

SEQ ID NO: 134 - protein, 564 aa, Artificial Sequence
  source: /note="Description of Artificial Sequence: Synthetic polypeptide"
AARKKKRGKIGITVKAKEKSPPAAGPFMARKLVNVAANVDGVEVHLCVECEADAHGSASARLLGGCRSCTGSIGAEGRLMGSVDVDRERVIAEPVHTETERLGPDVKAFEAGTAESKYAIQRGLEYWGVDLISRNRARTVRKMEEADRPESSTMEKTSWDEIAIKTYSQAYHASENHLFWERQRRVRQHALALFRRARERNRGESPLQSTQRPAPLVLAALHAEAAAISGRARAEYVLRGPSANVRAAAADIDAKPLGHYKTPSPKVARGFPVKRDLLRARHRIVGLSRAYFKPSDVVRGTSDAIAHVAGRNIGVAGGKPKEIEKTFTLPFVAYWEDVDRVVHCSSFKADGPWVRDQRIKIRGVSSAVGTFSLYGLDVAWSKPTSFYIRCSDIRKKFHPKGFGPMKHWRQWAKELDRLTEQRASCVVRALQDDEELLQTMERGQRYYDVFSCAATHATRGEADPSGGCSRCELVSCGVAHKVTKKAKGDTGIEAVAVAGCSLCESKLVGPSKPRVHRQMAALRQSHALNYLRRLQREWEALEAVQAPTPYLRFKYARHLEVRSM

SEQ ID NO: 135 - protein, 565 aa, Artificial Sequence
  source: /note="Description of Artificial Sequence: Synthetic polypeptide"
AAKKKKQRGKIGISVKPKEGSAPPADGPFMARKLVNVAANVDGVEVNLCIECEADAHGSAPARLLGGCKSCTGSIGAEGRLMGSVDVDRADAIAKPVNTETEKLGPDVQAFEAGTAETKYALQRGLEYWGVDLISRNRSRTVRRTEEGQPESATMEKTSWDEIAIKSYTRAYHASENHLFWERQRRVRQHALALFKRAKERNRGDSTLPREPGHGLVAIAALACEAYAVGGRNLAETVVRGPTFGTARAVRDVEIASLGRYKTPSPKVAHGSPVKRDFLRARHRIVGLARAYYRPSDVVRGTSDAIAHVAGRNIGVAGGKPRAVEAVFTLPFVAYWEDVDRVVHCSSFQVSAPWNRDQRMKIAGVTTAAGTFSLHGGELKWAKPTSFYIRCSDTRRKFRPKGFGPMKRWRQWAKDLDRLVEQRASCVVRALQDDAALLETMERGQRYYDVFACAVTHATRGEADRLAGCSRCALTPCQEAHRVTTKPRGDAGVEQVQTSDCSLCEGKLVGPSKPRLHRTLTLLRQEHGLNYLRRLQREWESLEAVQVPTPYLRFKYARHLEVRSM

SEQ ID NO: 136 - protein, 499 aa, Artificial Sequence
  source: /note="Description of Artificial Sequence: Synthetic polypeptide"
TDSQSESVPEVVYALTGGEVPGRVPPDGGSAEGARNAPTGLRKQRGKIKISAKPSKPGSPASSLARTLVNEAANVDGVQSSGCATCRMRANGSAPRALPIGCVACASSIGRAPQEETVCALPTTQGPDVRLLEGGHALRKYDIQRALEYWGVDLIGRNLDRQAGRGMEPAEGATATMKRVSMDELAVLDFGKSYYASEQHLFAARQRRVRQHAKALKIRAKHANRSGSVKRALDRSRKQVTALAREFFKPSDVVRGDSDALAHVVGRNLGVSRHPAREIPQTFTLPLCAYWEDVDRVISCSSLLAGEPFARDQEIRIEGVSSALGSLRLYRGAIEWHKPTSLYIRCSDTRRKFRPRGGLKKRWRQWAKDLDRLVEQRACCIVRSLQADVELLQTMERAQRFYDVHDCAATHVGPVAVRCSPCAGKQFDWDRYRLLAALRQEHALNYLRRLQREWESLEAQQVKMPYLRFKYARKLEVSGPLIGLEVRREPSMGTAIAEM

SEQ ID NO: 137 - protein, 358 aa, Artificial Sequence
  source: /note="Description of Artificial Sequence: Synthetic polypeptide"
AGTAGRRHGSLGARRSINIAGVTDRHGRWGCESCVYTRDQAGNRARCAPCDQSTYAPDVQEVTIGQRQAKYTIFLTLQSFSWTNTMRNNKRAAAGRSKRTTGKRIGQLAEIKITGVGLAHAHNVIQRSLQHNITKMWRAEKGKSKRVARLKKAKQLTKRRAYFRRRMSRQSRGNGFFRTGKGGIHAVAPVKIGLDVGMIASGSSEPADEQTVTLDAIWKGRKKKIRLIGAKGELAVAACRFREQQTKGDKCIPLILQDGEVRWNQNNWQCHPKKLVPLCGLEVSRKFVSQADRLAQNKVASPLAARFDKTSVKGTLVESDFAAVLVNVTSIYQQCHAMLLRSQEPTPSLRVQRTITSM

SEQ ID NO: 138 - protein, 369 aa, Artificial Sequence
  source: /note="Description of Artificial Sequence: Synthetic polypeptide"
GVRFSPAQSQVFFRTVIPQSVEARFAINMAAIHDAAGAFGCSVCRFEDRTPRNAKAVHGCSPCTRSTNRPDVFVLPVGAIKAKYDVFMRLLGFNWTHLNRRQAKRVTVRDRIGQLDELAISMLTGKAKAVLKKSICHNVDKSFKAMRGSLKKLHRKASKTGKSQLRAKLSDLRERTNTTQEGSHVEGDSDVALNKIGLDVGLVGKPDYPSEESVEVVVCLYFVGKVLILDAQGRIRDMRAKQYDGFKIPIIQRGQLTVLSVKDLGKWSLVRQDYVLAGDLRFEPKISKDRKYAECVKRIALITLQASLGFKERIPYYVTKQVEIKNASHIAFVTEAIQNCAENFREMTEYLMKYQEKSPDLKVLLTQLM

SEQ ID NO: 139 - protein, 486 aa, Artificial Sequence
  source: /note="Description of Artificial Sequence: Synthetic polypeptide"
RAVVGKVFLEQARRALNLATNFGTNHRTGCNGCYVTPGKLSIPQDGEKNAAGCTSCLMKATASYVSYPKPLGEKVAKYSTLDALKGFPWYSLRLNLRPNYRGKPINGVQEVAPVSKFRLAEEVIQAVQRYHFTELEQSFPGGRRRLRELRAFYTKEYRRAPEQRQHVVNGDRNIVVVTVLHELGFSVGMFNEVELLPKTPIECAVNVFIRGNRVLLEVRKPQFDKERLLVESLWKKDSRRHTAKWTPPNNEGRIFTAEGWKDFQLPLLLGSTSRSLRAIEKEGFVQLAPGRDPDYNNTIDEQHSGRPFLPLYLYLQGTISQEYCVFAGTWVIPFQDGISPYSTKDTFQPDLKRKAYSLLLDAVKHRLGNKVASGLQYGRFPAIEELKRLVRMHGATRKIPRGEKDLLKKGDPDTPEWWLLEQYPEFWRLCDAAAKRVSQNVGLLLSLKKQPLWQRRWLESRTRNEPLDNLPLSMALTLHLTNEEAL

SEQ ID NO: 140 - protein, 400 aa, Artificial Sequence
  source: /note="Description of Artificial Sequence: Synthetic polypeptide"
AAVYSKFYIENHFKMGIPETLSRIRGPSIIQGFSVNENYINIAGVGDRDFIFGCKKCKYTRGKPSSKKINKCHPCKRSTYPEPVIDVRGSISEFKYKIYNKLKQEPNQSIKQNTKGRMNPSDHTSSNDGIIINGIDNRIAYNVIFSSYKHLMEKQINLLRDTTKRKARQIKKYNNSGKKKHSLRSQTKGNLKNRYHMLGMFKKGSLTITNEGDFITAVRKVGLDISLYKNESLNKQEVETELCLNIKWGRTKSYTVSGYIPLPINIDWKLYLFEKETGLTLRLFGNKYKIQSKKFLIAQLFKPKRPPCADPVVKKAQKWSALNAHVQQMAGLFSDSHLLKRELKNRMHKQLDFKSLWVGTEDYIKWFEELSRSYVEGAEKSLEFFRQDYFCFNYTKQTTM

SEQ ID NO: 141 - protein, 666 aa, Artificial Sequence
  source: /note="Description of Artificial Sequence: Synthetic polypeptide"
PQQQRDLMLMAANYDQDYGNGCGPCTVVASAAYRPDPQAQHGCKRHLRTLGASAVTHVGLGDRTATITALHRLRGPAALAARARAAQAASAPMTPDTDAPDDRRRLEAIDADDVVLVGAHRALWSAVRRWADDRRAALRRRLHSEREWLLKDQIRWAELYTLIEASGTPPQGRWRNTLGALRGQSRWRRVLAPTMRATCAETHAELWDALAELVPEMAKDRRGLLRPPVEADALWRAPMIVEGWRGGHSVVVDAVAPPLDLPQPCAWTAVRLSGDPRQRWGLHLAVPPLGQVQPPDPLKATLAVSMRHRGGVRVRTLQAMAVDADAPMQRHLQVPLTLQRGGGLQWGIHSRGVRRREARSMASWEGPPIWTGLQLVNRWKGQGSALLAPDRPPDTPPYAPDAAVAPAQPDTKRARRTLKEACTVCRCAPGHMRQLQVTLTGDGTWRRFRLRAPQGAKRKAEVLKVATQHDERIANYTAWYLKRPEHAAGCDTCDGDSRLDGACRGCRPLLVGDQCFRRYLDKIEADRDDGLAQIKPKAQEAVAAMAAKRDARAQKVAARAAKLSEATGQRTAATRDASHEARAQKELEAVATEGTTVRHDAAAVSAFGSWVARKGDEYRHQVGVLANRLEHGLRLQELMAPDSVVADQQRASGHARVGYRYVLTAM

SEQ ID NO: 142 - protein, 560 aa, Artificial Sequence
  source: /note="Description of Artificial Sequence: Synthetic polypeptide"
AVAHPVGRGNAGSPGARGPEELPRQLVNRASNVTRPATYGCAPCRHVRLSIPKPVLTGCRACEQTTHPAPKRAVRGGADAAKYDLAAFFAGWAADLEGRNRRRQVHAPLDPQPDPNHEPAVTLQKIDLAEVSIEEFQRVLARSVKHRHDGRASREREKARAYAQVAKKRRNSHAHGARTRRAVRRQTRAVRRAHRMGANSGEILVASGAEDPVPEAIDHAAQLRRRIRACARDLEGLRHLSRRYLKTLEKPCRRPRAPDLGRARCHALVESLQAAERELEELRRCDSPDTAMRRLDAVLAAAASTDATFATGWTVVGMDLGVAPRGSAAPEVSPMEMAISVFWRKGSRRVIVSKPIAGMPIRRHELIRLEGLGTLRLDGNHYTGAGVTKGRGLSEGTEPDFREKSPSTLGFTLSDYRHESRWRPYGAKQGKTARQFFAAMSRELRALVEHQVLAPMGPPLLEAHERRFETLLKGQDNKSIHAGGGGRYVWRGPPDSKKRPAADGDWFRFGRGHADHRGWANKRHELAANYLQSAFRLWSTLAEAQEPTPYARYKYTRVTM

SEQ ID NO: 143 - protein, 404 aa, Artificial Sequence
  source: /note="Description of Artificial Sequence: Synthetic polypeptide"
WDFLTLQVYERHTSPEVCVAGNSTKCASGTRKSDHTHGVGVKLGAQEINVSANDDRDHEVGCNICVISRVSLDIKGWRYGCESCVQSTPEWRSIVRFDRNHKEAKGECLSRFEYWGAQSIARSLKRNKLMGGVNLDELAIVQNENVVKTSLKHLFDKRKDRIQANLKAVKVRMRERRKSGRQRKALRRQCRKLKRYLRSYDPSDIKEGNSCSAFTKLGLDIGISPNKPPKIEPKVEVVFSLFYQGACDKIVTVSSPESPLPRSWKIKIDGIRALYVKSTKVKFGGRTFRAGQRNNRRKVRPPNVKKGKRKGSRSQFFNKFAVGLDAVSQQLPIASVQGLWGRAETKKAQTICLKQLESNKPLKESQRCLFLADNWVVRVCGFLRALSQRQGPTPYIRYRYRCNM

SEQ ID NO: 144 - protein, 392 aa, Artificial Sequence
  source: /note="Description of Artificial Sequence: Synthetic polypeptide"
ARNVGQRNASRQSKRESAKARSRRVTGGHASVTQGVALINAAANADRDHTTGCEPCTWERVNLPLQEVIHGCDSCTKSSPFWRDIKVVNKGYREAKEEIMRIASGISADHLSRALSHNKVMGRLNLDEVCILDFRTVLDTSLKHLTDSRSNGIKEHIRAVHRKIRMRRKSGKTARALRKQYFALRRQWKAGHKPNSIREGNSLTALRAVGFDVGVSEGTEPMPAPQTEVVLSVFYKGSATRILRISSPHPIAKRSWKVKIAGIKALKLIRREHDFSFGRETYNASQRAEKRKFSPHAARKDFFNSFAVQLDRLAQQLCVSSVENLWVTEPQQKLLTLAKDTAPYGIREGARFADTRARLAWNWVFRVCGFTRALHQEQEPTPYCRFTWRSKM

SEQ ID NO: 145 - protein, 1228 aa, Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 146 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 147 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 148 - protein, 1246 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 149 - protein, 1373 aa, Moraxella bovoculi
MLFQDFTHLYPLSKTVRFELKPIDRTLEHIHAKNFLSQDETMADMHQKVKVILDDYHRDFIADMMGEVKLTKLAEFYDVYLKFRKNPKDDELQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFDKINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADKDYFEFHIDYAKFTDKAKNSRQIWTICSHGDKRYVYDKTANQNKGAAKGINVNDELKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 150 - protein, 1259 aa, Moraxella bovoculi
MGIHGVPAALFQDFTHLYPLSKTVRFELKPIGRTLEHIHAKNFLSQDETMADMYQKVKVILDDYHRDFIADMMGEVKLTKLAEFYDVYLKFRKNPKDDGLQKQLKDLQAVLRKESVKPIGSGGKYKTGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNRIIGEVNGYTNKHNQICHKSERIAKLRPLHKQILSDGMGVSFLPSKFADDSEMCQAVNEFYRHYTDVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHHTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKNVYQKMVYKLLPGPNKMLPKVFFAKSNLDYYNPSAELLDKYAKGTHKKGDNFNLKDCHALIDFFKAGINKHPEWQHFGFKFSPTSSYRDLSDFYREVEPQGYQVKFVDINADYIDELVEQGKLYLFQIYNKDFSPKAHGKPNLHTLYFKALFSEDNLADPIYKLNGEAQIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQVTTPYHKILDKREIERLNARVGWGEIETIKELKSGYLSHVVHQINQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNTDKGYFEFHIDYAKFTDKAKNSRQKWAICSHGDKRYVYDKTANQNKGAAKGINVNDELKSLFARYHINDKQPNLVMDICQNNDKEFHKSLMCLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 151 - protein, 1269 aa, Moraxella bovoculi
MGIHGVPAALFQDFTHLYPLSKTVRFELKPIGKTLEHIHAKNFLNQDETMADMYQKVKAILDDYHRDFIADMMGEVKLTKLAEFYDVYLKFRKNPKDDGLQKQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILATIKQKHSALYDQIINELTASGLDVSLASHLDGYHKLLTQEGITAYNTLLGGISGEAGSRKIQGINELINSHHNQHCHKSERIAKLRPLHKQILSDGMGVSFLPSKFADDSEVCQAVNEFYRHYADVFAKVQSLFDGFDDYQKDGIYVEYKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSDKSPEIRQLKELLDNALNVAHFAKLLTTKTTLHNQDGNFYGEFGALYDELAKIATLYNKVRDYLSQKPFSTEKYKLNFGNPTLLNGWDLNKEKDNFGVILQKDGCYYLALLDKAHKKVFDNAPNTGKSVYQKMIYKLLPGPNKMLPKVFFAKSNLDYYNPSAELLDKYAQGTHKKGDNFNLKDCHALIDFFKAGINKHPEWQHFGFKFSPTSSYQDLSDFYREVEPQGYQVKFVDINADYINELVEQGQLYLFQIYNKDFSPKAHGKPNLHTLYFKALFSEDNLVNPIYKLNGEAEIFYRKASLDMNETTIHRAGEVLENKNPDNPKKRQFVYDIIKDKRYTQDKFMLHVPITMNFGVQGMTIKEFNKKVNQSIQQYDEVNVIGIDRGERHLLYLTVINSKGEILEQRSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIAQSQAFFGKFDKICYNADRGYFEFHIDYAKFNDKAKNSRQIWKICSHGDKRYVYDKTANQNKGATIGVNVNDELKSLFTRYHINDKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 152 - protein, 1306 aa, Thiomicrospira sp.
MGIHGVPAATKTFDSEFFNLYSLQKTVRFELKPVGETASFVEDFKNEGLKRVVSEDERRAVDYQKVKEIIDDYHRDFIEESLNYFPEQVSKDALEQAFHLYQKLKAAKVEEREKALKEWEALQKKLREKVVKCFSDSNKARFSRIDKKELIKEDLINWLVAQNREDDIPTVETFNNFTTYFTGFHENRKNIYSKDDHATAISFRLIHENLPKFFDNVISFNKLKEGFPELKFDKVKEDLEVDYDLKHAFEIEYFVNFVTQAGIDQYNYLLGGKTLEDGTKKQGMNEQINLFKQQQTRDKARQIPKLIPLFKQILSERTESQSFIPKQFESDQELFDSLQKLHNNCQDKFTVLQQAILGLAEADLKKVFIKTSDLNALSNTIFGNYSVFSDALNLYKESLKTKKAQEAFEKLPAHSIHDLIQYLEQFNSSLDAEKQQSTDTVLNYFIKTDELYSRFIKSTSEAFTQVQPLFELEALSSKRRPPESEDEGAKGQEGFEQIKRIKAYLDTLMEAVHFAKPLYLVKGRKMIEGLDKDQSFYEAFEMAYQELESLIIPIYNKARSYLSRKPFKADKFKINFDNNTLLSGWDANKETANASILFKKDGLYYLGIMPKGKTFLFDYFVSSEDSEKLKQRRQKTAEEALAQDGESYFEKIRYKLLPGASKMLPKVFFSNKNIGFYNPSDDILRIRNTASHTKNGTPQKGHSKVEFNLNDCHKMIDFFKSSIQKHPEWGSFGFTFSDTSDFEDMSAFYREVENQGYVISFDKIKETYIQSQVEQGNLYLFQIYNKDFSPYSKGKPNLHTLYWKALFEEANLNNVVAKLNGEAEIFFRRHSIKASDKVVHPANQAIDNKNPHTEKTQSTFEYDLVKDKRYTQDKFFFHVPISLNFKAQGVSKFNDKVNGFLKGNPDVNIIGIDRGERHLLYFTVVNQKGEILVQESLNTLMSDKGHVNDYQQKLDKKEQERDAARKSWTTVENIKELKEGYLSHVVHKLAHLIIKYNAIVCLEDLNFGFKRGRFKVEKQVYQKFEKALIDKLNYLVFKEKELGEVGHYLTAYQLTAPFESFKKLGKQSGILFYVPADYTSKIDPTTGFVNFLDLRYQSVEKAKQLLSDFNAIRFNSVQNYFEFEIDYKKLTPKRKVGTQSKWVICTYGDVRYQNRRNQKGHWETEEVNVTEKLKALFASDSKTTTVIDYANDDNLIDVILEQDKASFFKELLWLLKLTMTLRHSKIKSEDDFILSPVKNEQGEFYDSRKAGEVWPKDADANGAYHIALKGLWNLQQINQWEKGKTLNLAIKNQDWFSFIQEKPYQE

SEQ ID NO: 153 - protein, 1214 aa, Butyrivibrio sp.
MGIHGVPAAYYQNLTKKYPVSKTIRNELIPIGKTLENIRKNNILESDVKRKQDYEHVKGIMDEYHKQLINEALDNYMLPSLNQAAEIYLKKHVDVEDREEFKKTQDLLRREVTGRLKEHENYTKIGKKDILDLLEKLPSISEEDYNALESFRNFYTYFTSYNKVRENLYSDEEKSSTVAYRLINENLPKFLDNIKSYAFVKAAGVLADCIEEEEQDALFMVETFNMTLTQEGIDMYNYQIGKVNSAINLYNQKNHKVEEFKKIPKMKVLYKQILSDREEVFIGEFKDDETLLSSIGAYGNVLMTYLKSEKINIFFDALRESEGKNVYVKNDLSKTTMSNIVFGSWSAFDELLNQEYDLANENKKKDDKYFEKRQKELKKNKSYTLEQMSNLSKEDISPIENYIERISEDIEKICIYNGEFEKIVVNEHDSSRKLSKNIKAVKVIKDYLDSIKELEHDIKLINGSGQELEKNLVVYVGQEEALEQLRPVDSLYNLTRNYLTKKPFSTEKVKLNFNKSTLLNGWDKNKETDNLGILFFKDGKYYLGIMNTTANKAFVNPPAAKTENVFKKVDYKLLPGSNKMLPKVFFAKSNIGYYNPSTELYSNYKKGTHKKGPSFSIDDCHNLIDFFKESIKKHEDWSKFGFEFSDTADYRDISEFYREVEKQGYKLTFTDIDESYINDLIEKNELYLFQIYNKDFSEYSKGKLNLHTLYFMMLFDQRNLDNVVYKLNGEAEVFYRPASIAENELVIHKAGEGIKNKNPNRAKVKETSTFSYDIVKDKRYSKYKFTLHIPITMNFGVDEVRRFNDVINNALRTDDNVNVIGIDRGERNLLYVVVINSEGKILEQISLNSIINKEYDIETNYHALLDEREDDRNKARKDWNTIENIKELKTGYLSQVVNVVAKLVLKYNAIICLEDLNFGFKRGRQKVEKQVYQKFEKMLIEKLNYLVIDKSREQVSPEKMGGALNALQLTSKFKSFAELGKQSGIIYYVPAYLTSKIDPTTGFVNLFYIKYENIEKAKQFFDGFDFIRFNKKDDMFEFSFDYKSFTQKACGIRSKWIVYTNGERIIKYPNPEKNNLFDEKVINVTDEIKGLFKQYRIPYENGEDIKEIIISKAEADFYKRLFRLLHQTLQMRNSTSDGTRDYIISPVKNDRGEFFCSEFSEGTMPKDADANGAYNIARKGLWVLEQIRQKDEGEKVNLSMTNAEWLKYAQLHLL

SEQ ID NO: 154 - protein, 1129 aa, Artificial Sequence
  source: /note="Description of Artificial Sequence: Synthetic polypeptide"
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 155 - protein, 1224 aa, Artificial Sequence
  source: /note="Description of Artificial Sequence: Synthetic polypeptide"
MKKIDNFVGCYPVSKTLRFKAIPIGKTQENIEKKRLVEEDEVRAKDYKAVKKLIDRYHREFIEGVLDNVKLDGLEEYYMLFNKSDREESDNKKIEIMEERFRRVISKSFKNNEEYKKIFSKKIIEEILPNYIKDEEEKELVKGFKGFYTAFVGYAQNRENMYSDEKKSTAISYRIVNENMPRFITNIKVFEKAKSILDVDKINEINEYILNNDYYVDDFFNIDFFNYVLNQKGIDIYNAIIGGIVTGDGRKIQGLNECINLYNQENKKIRLPQFKPLYKQILSESESMSFYIDEIESDDMLIDMLKESLQIDSTINNAIDDLKVLFNNIFDYDLSGIFINNGLPITTISNDVYGQWSTISDGWNERYDVLSNAKDKESEKYFEKRRKEYKKVKSFSISDLQELGGKDLSICKKINEIISEMIDDYKSKIEEIQYLFDIKELEKPLVTDLNKIELIKNSLDGLKRIERYVIPFLGTGKEQNRDEVFYGYFIKCIDAIKEIDGVYNKTRNYLTKKPYSKDKFKLYFENPQLMGGWDRNKESDYRSTLLRKNGKYYVAIIDKSSSNCMMNIEEDENDNYEKINYKLLPGPNKMLPKVFFSKKNREYFAPSKEIERIYSTGTFKKDTNFVKKDCENLITFYKDSLDRHEDWSKSFDFSFKESSAYRDISEFYRDVEKQGYRVSFDLLSSNAVNTLVEEGKLYLFQLYNKDFSEKSHGIPNLHTMYFRSLFDDNNKGNIRLNGGAEMFMRRASLNKQDVTVHKANQPIKNKNLLNPKKTTTLPYDVYKDKRFTEDQYEVHIPITMNKVPNNPYKINHMVREQLVKDDNPYVIGIDRGERNLIYVVVVDGQGHIVEQLSLNEIINENNGISIRTDYHTLLDAKERERDESRKQWKQIENIKELKEGYISQVVHKICELVEKYDAVIALEDLNSGFKNSRVKVEKQVYQKFEKMLITKLNYMVDKKKDYNKPGGVLNGYQLTTQFESFSKMGTQNGIMFYIPAWLTSKMDPTTGFVDLLKPKYKNKADAQKFFSQFDSIRYDNQEDAFVFKVNYTKFPRTDADYNKEWEIYTNGERIRVFRNPKKNNEYDYETVNVSERMKELFDSYDLLYDKGELKETICEMEESKFFEELIKLFRLTLQMRNSISGRTDVDYLISPVKNSNGYFYNSNDYKKEGAKYPKDADANGAYNIARKVLWAIEQFKMADEDKLDKTKISIKNQEWLEYAQTHCE

SEQ ID NO: 156 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 157 - protein, 1180 aa, Leptotrichia wadei
MYMKITKIDGVSHYKKQDKGILKKKWKDLDERKQREKIEARYNKQIESKIYKEFFRLKNKKRIEKEEDQNIKSLYFFIKELYLNEKNEEWELKNINLEILDDKERVIKGYKFKEDVYFFKEGYKEYYLRILFNNLIEKVQNENREKVRKNKEFLDLKEIFKKYKNRKIDLLLKSINNNKINLEYKKENVNEEIYGINPTNDREMTFYELLKEIIEKKDEQKSILEEKLDNFDITNFLENIEKIFNEETEINIIKGKVLNELREYIKEKEENNSDNKLKQIYNLELKKYIENNFSYKKQKSKSKNGKNDYLYLNFLKKIMFIEEVDEKKEINKEKFKNKINSNFKNLFVQHILDYGKLLYYKENDEYIKNTGQLETKDLEYIKTKETLIRKMAVLVSFAANSYYNLFGRVSGDILGTEVVKSSKTNVIKVGSHIFKEKMLNYFFDFEIFDANKIVEILESISYSIYNVRNGVGHFNKLILGKYKKKDINTNKRIEEDLNNNEEIKGYFIKKRGEIERKVKEKFLSNNLQYYYSKEKIENYFEVYEFEILKRKIPFAPNFKRKKGEDLFNNKNNKKYEYFKNFDKNSAEEKKEFLKTRNFLLKELYYNNFYKEFLSKKEEFEKIVLEVKEEKKSRGNINNKKSGVSFQSIDDYDTKINISDYIASIHKKEMERVEKYNEEKQKDTAKYIRDFVEEIFLTGFINYLEKDKRLHFLKEEFSILCNNNNNVVDFNININEEKIKEFLKENDSKTLNLYLFFNMIDSKRISEFRNELVKYKQFTKKRLDEEKEFLGIKIELYETLIEFVILTREKLDTKKSEEIDAWLVDKLYVKDSNEYKEYEEILKLFVDEKILSSKEAPYYATDNKTPILLSNFEKTRKYGTQSFLSEIQSNYKYSKVEKENIEDYNKKEEIEQKKKSNIEKLQDLKVELHKKWEQNKITEKEIEKYNNTTRKINEYNYLKNKEELQNVYLLHEMLSDLLARNVAFFNKWERDFKFIVIAIKQFLRENDKEKVNEFLNPPDNSKGKKVYFSVSKYKNTVENIDGIHKNFMNLIFLNNKFMNRKIDKMNCAIWVYFRNYIAHFLHLHTKNEKISLISQMNLLIKLFSYDKKVQNHILKSTKTLLEKYNIQINFEISNDKNEVFKYKIKNRLYSKKGKMLGKNNKFEILENEFLENVKAMLEYSE

SEQ ID NO: 158 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 159 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 160 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 161 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 162 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 163 - protein, 668 aa, Artificial Sequence
  source: /note="Description of Artificial Sequence: Synthetic polypeptide"
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 164 - protein, 796 aa, Artificial Sequence
  source: /note="Description of Artificial Sequence: Synthetic polypeptide"
MEKDKKGEKIDISQEMIEEDLRKILILFSRLRHSMVHYDYEFYQALYSGKDFVISDKNNLENRMISQLLDLNIFKELSKVKLIKDKAISNYLDKNTTIHVLGQDIKAIRLLDIYRDICGSKNGFNKFINTMITISGEEDREYKEKVIEHFNKKMENLSTYLEKLEKQDNAKRNNKRVYNLLKQKLIEQQKLKEWFGGPYVYDIHSSKRYKELYIERKKLVDRHSKLFEEGLDEKNKKELTKINDELSKLNSEMKEMTKLNSKYRLQYKLQLAFGFILEEFDLNIDTFINNFDKDKDLIISNFMKKRDIYLNRVLDRGDNRLKNIIKEYKFRDTEDIFCNDRDNNLVKLYILMYILLPVEIRGDFLGFVKKNYYDMKHVDFIDKKDKEDKDTFFHDLRLFEKNIRKLEITDYSLSSGFLSKEHKVDIEKKINDFINRNGAMKLPEDITIEEFNKSLILPIMKNYQINFKLLNDIEISALFKIAKDRSITFKQAIDEIKNEDIKKNSKKNDKNNHKDKNINFTQLMKRALHEKIPYKAGMYQIRNNISHIDMEQLYIDPLNSYMNSNKNNITISEQIEKIIDVCVTGGVTGKELNNNIINDYYMKKEKLVFNLKLRKQNDIVSIESQEKNKREEFVFKKYGLDYKDGEINIIEVIQKVNSLQEELRNIKETSKEKLKNKETLFRDISLINGTIRKNINFKIKEMVLDIVRMDEIRHINIHIYYKGENYTRSNIIKFKYAIDGENKKYYLKQHEINDINLELKDKFVTLICNMDKHPNKNKQTINLESNYIQNVKFIIP

SEQ ID NO: 165 - protein, 897 aa, Artificial Sequence
  source: /note="Description of Artificial Sequence: Synthetic polypeptide"
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 166 - protein, 919 aa, Artificial Sequence
  source: /note="Description of Artificial Sequence: Synthetic polypeptide"
MEEIKHKKNKSSIIRVIVSNYDMTGIKEIKVLYQKQGGVDTFNLKTIINLESGNLEIISCKPKEREKYRYEFNCKTEINTISITKKDKVLKKEIRKYSLELYFKNEKKDTVVAKVTDLLKAPDKIEGERNHLRKLSSSTERKLLSKTLCKNYSEISKTPIEEIDSIKIYKIKRFLNYRSNFLIYFALINDFLCAGVKEDDINEVWLIQDKEHTAFLENRIEKITDYIFDKLSKDIENKKNQFEKRIKKYKTSLEELKTETLEKNKTFYIDSIKTKITNLENKITELSLYNSKESLKEDLIKIISIFTNLRHSLMHYDYKSFENLFENIENEELKNLLDLNLFKSIRMSDEFKTKNRTNYLDGTESFTIVKKHQNLKKLYTYYNNLCDKKNGFNTFINSFFVTDGIENTDFKNLIILHFEKEMEEYKKSIEYYKIKISNEKNKSKKEKLKEKIDLLQSELINMREHKNLLKQIYFFDIHNSIKYKELYSERKNLIEQYNLQINGVKDVTAINHINTKLLSLKNKMDKITKQNSLYRLKYKLKIAYSFLMIEFDGDVSKFKNNFDPTNLEKRVEYLDKKEEYLNYTAPKNKFNFAKLEEELQKIQSTSEMGADYLNVSPENNLFKFYILTYIMLPVEFKGDFLGFVKNHYYNIKNVDFMDESLLDENEVDSNKLNEKIENLKDSSFFNKIRLFEKNIKKYEIVKYSVSTQENMKEYFKQLNLDIPYLDYKSTDEIGIFNKNMILPIFKYYQNVFKLCNDIEIHALLALANKKQQNLEYAIYCCSKKNSLNYNELLKTFNRKTYQNLSFIRNKIAHLNYKELFSDLFNNELDLNTKVRCLIEFSQNNKFDQIDLGMNFINDYYMKKTRFIFNQRRLRDLNVPSKEKIIDGKRKQQNDSNNELLKKYGLSRTNIKDIFNKAWY

SEQ ID NO: 167 - protein, 1110 aa, Artificial Sequence
  source: /note="Description of Artificial Sequence: Synthetic polypeptide"
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 168 - DNA, 20 bp, Artificial Sequence
  source: /note="Description of Artificial Sequence: Synthetic oligonucleotide"
gagtatgggagagtaggtcg

SEQ ID NO: 169 - DNA, 20 bp, Artificial Sequence
  source: /note="Description of Artificial Sequence: Synthetic oligonucleotide"
tttttttttttttttttttt

SEQ ID NO: 170 - DNA, 21 bp, Artificial Sequence
  source: /note="Description of Artificial Sequence: Synthetic oligonucleotide"
taattaattaattaattaatt

SEQ ID NO: 171 - DNA, 5 bp, Artificial Sequence
  source: /note="Description of Artificial Sequence: Synthetic oligonucleotide"
aaaaa

SEQ ID NO: 172 - DNA, 5 bp, Artificial Sequence
  source: /note="Description of Artificial Sequence: Synthetic oligonucleotide"
ccccc

SEQ ID NO: 173 - DNA, 5 bp, Artificial Sequence
  source: /note="Description of Artificial Sequence: Synthetic oligonucleotide"
ggggg

SEQ ID NO: 174 - DNA, 5 bp, Artificial Sequence
  source: /note="Description of Artificial Sequence: Synthetic oligonucleotide"
ttttt

SEQ ID NO: 175 - DNA, 6 bp, Artificial Sequence
  source: /note="Description of Artificial Sequence: Synthetic oligonucleotide"
ttatta

SEQ ID NO: 176 - DNA, 10 bp, Artificial Sequence
  source: /note="Description of Artificial Sequence: Synthetic oligonucleotide"
attattatta

SEQ ID NO: 177 - DNA, 7 bp, Artificial Sequence
  source: /note="Description of Artificial Sequence: Synthetic oligonucleotide"
ttttttt

SEQ ID NO: 178 - DNA, 11 bp, Artificial Sequence
  source: /note="Description of Artificial Sequence: Synthetic oligonucleotide"
ttttttttttt

SEQ ID NO: 179 - DNA, 35 bp, Artificial Sequence
  source: /note="Description of Artificial Sequence: Synthetic oligonucleotide"
ccggcagccataacgccgtgaatacgttctgccgg

SEQ ID NO: 180 - DNA, 54 bp, Homo sapiens
gttgggcgagtacgggctgcaggcatacactgaagtgaaaactgtgagtgtggg

SEQ ID NO: 181 - DNA, 54 bp, Homo sapiens
gttgggcgagtacgggctgcaggcatacactaaagtgaaaactgtgagtgtggg

What is claimed is:

1. A device for measuring a signal comprising:
   (a) a sliding layer comprising a channel with an opening at a first end of the channel and an opening at a second end of the channel; and
   (b) a fixed layer comprising:
      i) a first chamber having an opening;
      ii) a second chamber having an opening;
      iii) a first side channel having an opening aligned with the opening of the first chamber; and
      iv) a second side channel having an opening aligned with the opening of the second chamber,
   wherein the sliding layer and the fixed layer are configured to move relative to each other between i) a first configuration and ii) a second configuration,
   wherein, in the first configuration, the sliding layer and the fixed layer are arranged to fluidically connect the first chamber and the first side channel via the opening at the first end of the channel, the opening at the second end of the channel, the opening of the first chamber, and the opening of the first side channel, wherein, in the second configuration, the sliding layer and the fixed layer are arranged to fluidically connect the second chamber and the second side channel via the opening at the first end of the channel, the opening at the second end of the channel, the opening of the second chamber, and the opening of the second side channel, and wherein the device is configured to allow a fluid to move between the first chamber and the channel when the sliding layer and the fixed layer are in the first configuration and between the second chamber and the channel in the second configuration, so as to enable the fluid to move between the first chamber and the second chamber via the channel.

2. The device of claim 1, wherein the fixed layer further comprises:
   i) a third chamber having an opening; and
   ii) a third side channel having an opening aligned with the opening of the third chamber,
   wherein the sliding layer and the fixed layer move relative to each other between the first configuration, the second configuration, and a third configuration,
   wherein, in the third configuration, the sliding layer and the fixed layer are arranged to fluidically connect the third chamber and the third side channel via the opening at the first end of the channel, the opening at the second end of the channel, the opening of the third chamber, and the opening of the third side channel, and
   wherein fluid is configured to move between the third chamber and the channel in the third configuration.

3. The device of claim 1, wherein, in the first configuration, the opening of the first end of the channel overlaps with the opening of the first chamber and the opening of the second end of the channel overlaps with the opening of the first side channel.

4. The device of claim 1, wherein, in the second configuration, the opening of the first end of the channel overlaps with the opening of the second chamber and the opening of the second end of the channel overlaps with the opening of the second side channel.

5. The device of claim 2, wherein, in the third configuration, the opening of the first end of the channel overlaps with the opening of the third chamber and the opening of the second end of the channel overlaps with the opening of the third side channel.

6. The device of claim 2, wherein the first side channel, the second side channel, and the third side channel are fluidically connected to a mixing chamber.

7. The device of claim 2, wherein the third chamber comprises a forward primer, a reverse primer, a dNTP, an NTP, a polymerase, a reverse transcriptase, a T7 polymerase, or any combination thereof.

8. The device of claim 7, wherein the forward primer, the reverse primer, or both comprises a T7 promoter.

9. The device of claim 8, wherein a programmable nuclease, a reporter, a guide nucleic acid, the forward primer, the reverse primer, the dNTP, the NTP, the polymerase, the reverse transcriptase, the T7 promoter, the T7 polymerase, or any combination thereof is lyophilized or vitrified.

10. The device of claim 1, wherein the second chamber is optically connected to a spectrophotometric measurement device or a fluorescence measurement device.

11. The device of claim 1, wherein the second chamber comprises a metal lead adapted for measurement of a change in current.

12. The device of claim 1, wherein the first chamber holds a volume of from 20 µL to 1000 µL.

13. The device of claim 1, wherein the second chamber holds a volume of from 1 µL to 50 µL.

14. The device of claim 2, wherein the third chamber holds a volume of from 1 µL to 50 µL.

15. The device of claim 1, wherein the second chamber comprises a plurality of guide RNAs.

16. The device of claim 1, wherein the device comprises from 2 to 20 chambers comprising a programmable nuclease, a guide nucleic acid, and a reporter, wherein a detection chamber of the from 2 to 20 chambers comprises a unique guide nucleic acid.

17. A method of detecting a presence or an absence of a target nucleic acid in a sample, the method comprising:
   providing a device comprising:
      (a) a sliding layer comprising a channel with an opening at a first end of the channel and an opening at a second end of the channel; and
      (b) a fixed layer comprising:
         i) a first chamber having an opening;
         ii) a second chamber having an opening;
         iii) a first side channel having an opening aligned with the opening of the first chamber; and
         (iv) a second side channel having an opening aligned with the opening of the second chamber,
      wherein the sliding layer and the fixed layer move relative to each other between a first configuration and a second configuration,
      wherein, in the first configuration, the sliding layer and the fixed layer are arranged to fluidically connect the first chamber and the first side channel via the opening at the first end of the channel, the opening at the second end of the channel, the opening of the first chamber, and the opening of the first side channel,
      wherein, in the second configuration, the sliding layer and the fixed layer are arranged to fluidically connect the second chamber and the second side channel via the opening at the first end of the channel, the opening at the second end of the channel, the opening of the second chamber, and the opening of the second side channel,
      wherein fluid is configured to move between the first chamber and the channel when the sliding layer and the fixed layer are in the first configuration and between the second chamber and the channel when the sliding layer and the fixed layer are in the second configuration;
   sliding the sliding layer and the fixed layer relative to each other into the first configuration;
   moving a first volume from the first chamber into the channel when the sliding layer and the fixed layer are in the first configuration;
   sliding the sliding layer and the fixed layer relative to each other into the second configuration;
   moving the first volume from the channel into the second chamber when the sliding layer and the fixed layer are in the second configuration, thereby contacting the first volume to a second volume contained within the second chamber;
   wherein the first volume comprises the sample and the second volume comprises:
      i) a guide nucleic acid comprising at least 10 nucleotides reverse complementary to a target nucleic acid or portion thereof in the sample;
      ii) a programmable nuclease activated upon binding of the guide nucleic acid to the target nucleic acid;

iii) a reporter comprising a nucleic acid and a detection moiety,
wherein the second volume is greater than the first volume: and measuring a signal produced by cleavage of the nucleic acid of the reporter, wherein cleavage occurs when the programmable nuclease is activated.

18. The device of claim 1, wherein the first side channel and the second side channel are fluidically connected.

19. The device of claim 18, wherein the first side channel is configured to receive the fluid from the channel in the first configuration, and wherein the channel is configured to receive the fluid from the second side channel in the second configuration.

20. A system comprising the device of claim 1 and a pump configured to move the fluid.

21. The method of claim 17, wherein the sliding layer and the fixed layer move relative to each other between the first configuration, the second configuration, and a third configuration, wherein, in the third configuration, the sliding layer and the fixed layer are arranged to fluidically connect a third chamber and a third side channel via the opening at the first end of the channel, the opening at the second end of the channel, an opening of the third chamber, and an opening of the third side channel.

22. The method of claim 21, further comprising moving a third volume comprising the first volume and the second volume from the second chamber into the channel when the sliding layer and the fixed layer are in the second configuration, then moving the third volume from the channel to the third chamber when the sliding layer and the fixed layer are in the third configuration, thereby contacting the third volume to a fourth volume contained within the third chamber.

23. The method of claim 21, wherein the first side channel, the second side channel, and the third side channel are fluidically connected to a mixing chamber.

24. The method of claim 17, wherein the second chamber is optically connected to a spectrophotometric measurement device or a fluorescence measurement device, wherein the signal is an optical signal, and wherein measuring the signal comprises measuring the optical signal with the spectrophotometric measurement device or the fluorescence measurement device.

25. The method of claim 17, wherein the device comprises from 2 to 20 chambers comprising a programmable nuclease, a guide nucleic acid, and a reporter, wherein a detection chamber of the from 2 to 20 chambers comprises a unique guide nucleic acid.

26. The method of claim 17, wherein the reporter is a hybrid reporter having at least one ribonucleotide and at least one deoxyribonucleotide.

27. The method of claim 17, further comprising immobilizing the reporter to a surface.

28. The method of claim 27, wherein the surface is a surface of the second chamber.

29. The method of claim 17, wherein the programmable nuclease is a Type VI CRISPR/Cas enzyme.

30. The method of claim 29, wherein the Type VI CRISPR/Cas enzyme is a programmable Cas13 nuclease.

31. The method of claim 17, wherein the programmable nuclease is a Type V CRISPR/Cas enzyme.

32. The method of claim 31, wherein the Type V CRISPR/Cas enzyme is a programmable Cas12 nuclease.

33. The method of claim 31, wherein the Type V CRISPR/Cas enzyme is a programmable Cas14 nuclease.

34. The method of claim 17, wherein the programmable nuclease comprises a RuvC nuclease domain.

35. The method of claim 17, wherein the programmable nuclease comprises a HEPN nuclease domain.

36. The method of claim 17, wherein the programmable nuclease is an RNA-guided nuclease.

37. The device of claim 1, wherein the second chamber comprises a programmable nuclease and a reporter comprising a nucleic acid and a detection moiety.

38. The method of claim 17, wherein the signal is a change in current and wherein measuring the signal comprises measuring the change in current.

39. The device of claim 37, wherein the second chamber is coupled to a measurement device for measuring a signal from the detection moiety produced by cleavage of the nucleic acid of the reporter.

40. The device of claim 37, wherein the second chamber comprises a guide nucleic acid.

41. The device of claim 37, wherein the reporter is a hybrid reporter having at least one ribonucleotide and at least one deoxyribonucleotide.

42. The device of claim 37, wherein the reporter is immobilized to a surface.

43. The device of claim 42, wherein the surface is a surface of the second chamber.

44. The device of claim 37, wherein the programmable nuclease is a Type VI CRISPR/Cas enzyme.

45. The device of claim 44, wherein the Type VI CRISPR/Cas enzyme is a programmable Cas13 nuclease.

46. The device of claim 37, wherein the programmable nuclease is a Type V CRISPR/Cas enzyme.

47. The device of claim 46, wherein the Type V CRISPR/Cas enzyme is a programmable Cas12 nuclease.

48. The device of claim 46, wherein the Type V CRISPR/Cas enzyme is a programmable Cas14 nuclease.

49. The device of claim 37, wherein the programmable nuclease comprises a RuvC nuclease domain.

50. The device of claim 37, wherein the programmable nuclease comprises a HEPN nuclease domain.

51. The device of claim 37, wherein the programmable nuclease is an RNA-guided nuclease.

* * * * *